United States Patent
Xie et al.

(10) Patent No.: US 10,563,207 B2
(45) Date of Patent: Feb. 18, 2020

(54) MODULAR CONSTRUCTION OF SYNTHETIC GENE CIRCUITS IN MAMMALIAN CELLS USING TALE TRANSCRIPTIONAL REPRESSORS

(71) Applicant: TSINGHUA UNIVERSITY, Beijing (CN)

(72) Inventors: Zhen Xie, Beijing (CN); Ron Weiss, Cambridge, MA (US); Yinqing Li, Cambridge, MA (US); Yun Jiang, Beijing (CN); Weixi Liao, Beijing (CN); He Chen, Beijing (CN)

( * ) Notice: Subject to any disclaimer, the term of this patent is extended or adjusted under 35 U.S.C. 154(b) by 0 days.

(21) Appl. No.: 15/307,355

(22) PCT Filed: Mar. 6, 2015

(86) PCT No.: PCT/CN2015/000139
§ 371 (c)(1),
(2) Date: Oct. 27, 2016

(87) PCT Pub. No.: WO2015/165275
PCT Pub. Date: Nov. 5, 2015

(65) Prior Publication Data
US 2017/0145426 A1     May 25, 2017

(30) Foreign Application Priority Data

Apr. 30, 2014  (CN) .......................... 2014 1 0183417
Jul. 17, 2014   (CN) .......................... 2014 1 0342334

(51) Int. Cl.
| | |
|---|---|
| *C12N 15/63* | (2006.01) |
| *C12N 15/85* | (2006.01) |
| *C12N 15/64* | (2006.01) |
| *C12N 15/113* | (2010.01) |
| *C12N 15/90* | (2006.01) |
| *C12Q 1/6888* | (2018.01) |

(52) U.S. Cl.
CPC .......... *C12N 15/635* (2013.01); *C12N 15/113* (2013.01); *C12N 15/63* (2013.01); *C12N 15/64* (2013.01); *C12N 15/85* (2013.01); *C12N 15/907* (2013.01); *C12Q 1/6888* (2013.01); *C12N 2310/14* (2013.01); *C12N 2310/531* (2013.01); *C12Q 2600/158* (2013.01); *C12Q 2600/178* (2013.01)

(58) Field of Classification Search
None
See application file for complete search history.

(56) References Cited

U.S. PATENT DOCUMENTS

2013/0096182 A1    4/2013  Chatterjee et al.

FOREIGN PATENT DOCUMENTS

| | | |
|---|---|---|
| CN | 102770539 A | 11/2012 |
| CN | 104611365 A | 5/2015 |
| WO | WO 2013/158046 A1 | 10/2013 |
| WO | WO 2013/185892 A1 | 12/2013 |
| WO | WO-2014046626 A1 * | 3/2014 ............. C12N 15/63 |
| WO | WO 2014/182700 A1 | 11/2014 |

OTHER PUBLICATIONS

Xie et al in "Multi-input RNAi-based logic circuit for identification of specific cancer cells." (Science vol. 333, No. 6047; Sep. 2, 2011: pp. 1307-1311 (Year: 2011).*
Garg et al: Engineering synthetic TAL effectors with orthogonal target sites NAR vol. 40, No. 15, May 11, 2012 pp. 7584-7595. (Year: 2012).*
Cong et al. 2012 "Comprehensive Interrogation of Natural TALE DNA Binding Modules and Transcriptional Repressor Domains" *Nat Commun* 3: 968 (in 13 pages).

* cited by examiner

*Primary Examiner* — Catherine S Hibbert
(74) *Attorney, Agent, or Firm* — Bioinnovation Legal PLLC; James Christopher Schroeder

(57) ABSTRACT

Provided is a modular construction of synthetic gene circuits in mammalian cells using TALE transcriptional repressors. Provided is a method for achieving regulated expression of two proteins: an expression cassette A comprises a feedback element coding sequence, a promoter A, a protein A and TALER protein A encoding gene linked by means of a self-cleaving polypeptide, and a target sequence A (comprising an shRNA1 target sequence); an expression cassette B comprises a feedback element coding sequence, a promoter B, a protein B and TALER protein B encoding gene linked by means of a self-cleaving polypeptide, and a target sequence B (comprising an shRNA2 target sequence); an expression cassette C comprises a constitutive promoter and an activating element-coding sequence; a recombinant vector A having the expression cassette A, a recombinant vector B having the expression cassette B, and a recombinant vector C having the expression cassette C are introduced into host cells to regulate the expression of protein A and protein B by adding shRNA1 or shRNA2.

10 Claims, 17 Drawing Sheets

Specification includes a Sequence Listing.

A

B

C

MODULAR CONSTRUCTION OF SYNTHETIC GENE CIRCUITS IN MAMMALIAN CELLS USING TALE TRANSCRIPTIONAL REPRESSORS

TECHNICAL FIELD

The present invention relates to modular construction of synthetic gene circuits in mammalian cells using TALE transcriptional repressors.

REFERENCE TO SEQUENCE LISTING

A Sequence Listing submitted as an ASCII text file via EFS-Web is hereby incorporated by reference in accordance with 35 U.S.C. § 1.52(e). The name of the ASCII text file for the Sequence Listing is 25006226_1.TXT, the date of creation of the ASCII text file is Jan. 12, 2017, and the size of the ASCII text file is 1.41 MB.

BACKGROUND ART

Synthetic gene circuits are carefully designed to assemble functionally genetic regulatory devices and implement certain functions through sensing, integration and processing of molecular information in cells. Various synthetic gene circuits have been developed to achieve customizable, programmable functions in cells, including dynamic behaviours, switches and memory, inter-cellular communication, adaptability, cell polarization, digital and analog computation and complex biosynthetic pathways. Most of these gene circuits are constructed by using limited genetic elements and costly, inefficient "trial-error" methods. Therefore, to simplify the design and optimize the sophisticated operation of living cells, the development of a large-scale, functionally well-defined synthetic genetic element library and corresponding computation model and simulation method is very needed.

In the research field of synthetic biology of mammals, engineered synthesis of transcriptional activators and repressors is an important goal in supporting the design of extensible gene circuits. At present, a common strategy for constructing mammalian/eukaryotic transcriptional repressors is to fuse a transcriptional repression domain and an engineered DNA-binding protein domain, such as zinc finger protein, transcription activator-like effector (TALE) and deactivated Cas9 (dCas9) nuclease in the RNA-guided CRISPR (clustered regularly interspaced short palindromic repeats) System. However, transcriptional repression domains, such as the Krüppel-associated box (KRAB) transcriptional repression domain and the mSin interaction domain (SID4), often result in epigenetic modifications nearby the target promoter and thus have a slow response to time. Thus, such transcriptional repression is not suitable for constructing fast-responded and reversible gene circuits.

Another transcription repression mode generally present in prokaryotes is through steric hindrance of nonfunctional domains, which are not common in eukaryotes. For example, the Lac inhibitor (LacI) and tetracycline repressor (TetR) bind to specific DNA sequence nearby the promoter by oligomerization to make DNA form a loop, and therefore prevent the binding of the transcriptional initiation core elements to the promoter region. Previous studies have shown that in context of regulation of the mammalian genes, placing the LacI binding site downstream of the cytomegalovirus (CMV) promoter or CAG promoter in a synthetic gene circuit inhibits gene expression, despite the efficiency of repression in mammalian expression systems is lower than that in prokaryotic expression systems. Similarly, the dCas9 protein still exhibits weak transcriptional repression function in mammalian system without fusing to any transcriptional repression domain.

The transcription activator-like effector repressor (TALER) protein consists of several "protein modules" in series that specifically recognize DNA, and N-terminal and C-terminal sequences on either side. Each "protein module" contains 33-35 amino acid residues, and the amino acid residues at position 12 and position 13, the key sites for target recognition, are called repeat variable di-residues (RVDs) of amino acid. Each RVD on the TALER protein can recognize only one base. Transcription activator-like effector nuclease (TALEN) is a kind of artificial restriction endonuclease, and is a TALEN fusion protein obtained by the fusion of TALER protein (as a DNA binding domain) with a restriction endonuclease Fok I (as a DNA cleavage domain, also known as a repression domain). TALEN binds to the target site of the genome in cells to form a dimer performing endonuclease activity, which results in DNA's double-strand breaks (DSB) in the spacer regions of TALEN on the left and right sides and thus induces DNA damage repair mechanism. Cells can repair DNA by a non-homologous end-joining (NHEJ) mechanism. NHEJ repair mechanism is not accurate. It is prone to occur errors (deletion/insertion), resulting in frameshift mutation and therefore achieving the purpose of gene knockout.

DISCLOSURE OF THE INVENTION

The objective of the present invention is to provide modular construction of synthetic gene circuits in mammalian cells using TALE transcriptional repressors.

The first method for achieving the regulated expression of two proteins claimed by the present invention, comprises the following steps:

Said two proteins are named as protein A and protein B, respectively. Protein A-encoding gene is located in an expression cassette A-I, and protein B-encoding gene is located in an expression cassette B-I;

Said expression cassette A-I comprises the following elements successively from upstream to downstream: a feedback element coding sequence, a promoter A, a protein A-encoding gene and TALER protein A-encoding gene linked by means of self-cleaving polypeptide encoding gene, a target sequence A-I; said target sequence A-I comprises more than one (specifically, may be 4) shRNA1 target sequences;

Said expression cassette B-I comprises the following elements successively from upstream to downstream: a feedback element coding sequence, a promoter B, a protein B-encoding gene and TALER protein B-encoding gene linked by means of self-cleaving polypeptide encoding gene, a target sequence B-I; said target sequence B-I comprises more than one (specifically, may be 4) shRNA2 target sequences;

In said expression cassette A-I, both the upstream and downstream of said promoter A have at least one said TALER protein B target, respectively, or the upstream of said promoter A has no said TALER protein B target but the downstream thereof has at least one said TALER protein B target;

In said expression cassette B-I, both the upstream and downstream of said promoter B have at least one said TALER protein A target, respectively, or the upstream of said promoter B has no said TALER protein A target but the downstream thereof has at least one said TALER protein A target;

Said expression cassette C comprises a constitutive promoter- and an activating element-coding sequence successively from upstream to downstream; a DNA positioned downstream of said feedback element coding sequence is expressed under the stimulation of said activating element;

A recombinant vector A-I with said expression cassette A-I, a recombinant vector B-I with said expression cassette B-I, and a recombinant vector C with said expression cassette C are introduced into host cells. The expression of said protein A and the expression of said protein B are regulated by adding shRNA1 or shRNA2.

In said expression cassette A-I, the upstream of said promoter A has one said TALER protein B target and the downstream thereof has one to three said TALER protein B targets;

In said expression cassette B-I, the upstream of said promoter B has one said TALER protein A target and the downstream thereof has one to three said TALER protein A targets;

In said expression cassette A-I, the distance between the TALER protein B target upstream of said promoter A and the nearest TALER protein B target downstream of said promoter A is 72-100 bp;

In said expression cassette B-I, the distance between the TALER protein A target upstream of said promoter B and the nearest TALER protein A target downstream of said promoter B is 72-100 bp;

The second method for achieving the regulated expression of two proteins claimed by the present invention, comprises the following steps:

Said two proteins are named as protein A and protein B, respectively. Protein A-encoding gene is located in an expression cassette A-I, and protein B-encoding gene is located in an expression cassette B-I;

Said expression cassette A-I comprises the following elements successively from upstream to downstream: a feedback element coding sequence, a promoter A, a protein A-encoding gene and TALER protein A-encoding gene linked by means of a self-cleaving polypeptide encoding gene, a target sequence A-I; said target sequence A-I comprises a shRNA1-1 target sequence, . . . , a shRNA1-n target sequence, wherein n is a natural number of 2 or more;

Said expression cassette B-I comprises the following elements successively from upstream to downstream: a feedback element coding sequence, a promoter B, a protein B-encoding gene and TALER protein B-encoding gene linked by means of a self-cleaving polypeptide encoding gene, a target sequence B-I; said target sequence B-I comprises a shRNA2-1 target sequence, . . . , a shRNA2-n target sequence, wherein n is a natural number of 2 or more;

In said expression cassette A-I, both the upstream and downstream of said promoter A have at least one said TALER protein B target, respectively, or the upstream of said promoter A has no said TALER protein B target but the downstream thereof has at least one said TALER protein B target;

In said expression cassette B-I, both the upstream and downstream of said promoter B have at least one said TALER protein A target, respectively, or the upstream of said promoter B has no said TALER protein A target but the downstream thereof has at least one said TALER protein A target;

Said expression cassette C comprises a constitutive promoter- and an activating element-coding sequence successively from upstream to downstream; a DNA positioned downstream of said feedback element coding sequence is expressed under the stimulation of said activating element;

A recombinant vector A-I with said expression cassette A-I, a recombinant vector B-I with said expression cassette B-I, and a recombinant vector C with said expression cassette C are introduced into host cells. The expression of said protein A and the expression of said protein B are regulated by adding shRNA1-1, . . . , shRNA1-n, shRNA2-1, . . . , or shRNA2-n.

In said expression cassette A-I, the upstream of said promoter A has one said TALER protein B target and the downstream thereof has one to three said TALER protein B targets;

In said expression cassette B-I, the upstream of said promoter B has one said TALER protein A target and the downstream thereof has one to three said TALER protein A targets;

In said expression cassette A-I, the distance between the TALER protein B target upstream of said promoter A and the nearest TALER protein B target downstream of said promoter A is 72-100 bp;

In said expression cassette B-I, the distance between the TALER protein A target upstream of said promoter B and the nearest TALER protein A target downstream of said promoter B is 72-100 bp;

The third method for achieving the regulated expression of two proteins claimed by the present invention, comprises the following steps:

Said two proteins are named as protein A and protein B, respectively. Protein A-encoding gene is located in an expression cassette A-I, and protein B-encoding gene is located in an expression cassette B-I, protein B-encoding gene is located in an expression cassette D-I;

Said expression cassette A-I comprises the following elements successively from upstream to downstream: a feedback element coding sequence, a promoter A, a protein A-encoding gene and TALER protein A-encoding gene linked by means of a self-cleaving polypeptide encoding gene, a target sequence A-I; said target sequence A-I comprises a shRNA1-1 target sequence, . . . , a shRNA1-n target sequence, wherein n is a natural number of 2 or more;

Said expression cassette B-I comprises the following elements successively from upstream to downstream: a feedback element coding sequence, a promoter B, a protein B-encoding gene and TALER protein B-encoding gene linked by means of a self-cleaving polypeptide encoding gene, a target sequence B-I; said target sequence B-I comprises a shRNA2-1 target sequence, . . . , a shRNA2-n target sequence, wherein n is a natural number of 2 or more;

Said expression cassette D-I comprises the following elements successively from upstream to downstream: a feedback element coding sequence, a promoter D, a protein B-encoding gene and TALER protein B-encoding gene linked by means of a self-cleaving polypeptide encoding gene, a target sequence D; said target sequence D-I comprises a shRNA3-1 target sequence, . . . , a shRNA3-n target sequence, wherein n is a natural number of 2 or more;

In said expression cassette A-I, both the upstream and downstream of said promoter A have at least one said TALER protein B target, respectively, or the upstream of said promoter A has no said TALER protein B target but the downstream thereof has at least one said TALER protein B target;

In said expression cassette B-I, both the upstream and downstream of said promoter B have at least one said TALER protein A target, respectively, or the upstream of said promoter B has no said TALER protein A target but the downstream thereof has at least one said TALER protein A target;

In said expression cassette D-I, both the upstream and downstream of said promoter D have at least one said TALER protein A target, respectively, or the upstream of said promoter D has no said TALER protein A target but the downstream thereof has at least one said TALER protein A target;

Said expression cassette C comprises a constitutive promoter- and an activating element-coding sequence successively from upstream to downstream; a DNA positioned downstream of said feedback element coding sequence is expressed under the stimulation of said activating element;

A recombinant vector A-I with said expression cassette A-I, a recombinant vector B-I with said expression cassette B-I, a recombinant vector C with said expression cassette C and a recombinant vector D-I with said expression cassette D-I are introduced into host cells. The expression of said protein A and the expression of said protein B are regulated by adding shRNA1-1, . . . , shRNA1-n, shRNA2-1, . . . , shRNA2-n, shRNA3-1, . . . , shRNA3-n.

In said expression cassette A-I, the upstream of said promoter A has one said TALER protein B target and the downstream thereof has one to three said TALER protein B targets;

In said expression cassette B-I, the upstream of said promoter B has one said TALER protein A target and the downstream thereof B has one to three said TALER protein A targets;

In said expression cassette D-I, the upstream of said promoter D has one said TALER protein A target and the downstream thereof has one to three said TALER protein A targets;

In said expression cassette A-I, the distance between the TALER protein B target upstream of said promoter A and the nearest TALER protein B target downstream of said promoter A is 72-100 bp;

In said expression cassette B-I, the distance between the TALER protein A target upstream of said promoter B and the nearest TALER protein A target downstream of said promoter B is 72-100 bp;

In said expression cassette D-I, the distance between the TALER protein A target upstream of said promoter D and the nearest TALER protein A target downstream of said promoter D is 72-100 bp.

The first method for sorting cell A and/or cell B from mixed cells claimed by the present invention comprises the following steps:

Said cell A has a specific miRNA 1; said cell B has a specific miRNA2;

A recombinant vector A-II having an expression cassette A-II, a recombinant vector B-II having an expression cassette B-II, and a recombinant vector C having an expression cassette C are introduced into said mixed cells. Said cell A and/or said cell B are sorted by detecting the intensity of a fluorescent protein A and/or a fluorescent protein B; said fluorescent protein A and said fluorescent protein B have different fluorescent colours;

Said expression cassette A-II comprises the following elements successively from upstream to downstream: a feedback element coding sequence, a promoter A, said fluorescent protein A-encoding gene and TALER protein A-encoding gene linked by means of a self-cleaving polypeptide encoding gene, a target sequence A-II; said target sequence A-II comprises more than one (specifically, may be 4) miRNA1 target sequences;

Said expression cassette B-II comprises the following elements successively from upstream to downstream: a feedback element coding sequence, a promoter B, said fluorescent protein B-encoding gene and TALER protein B-encoding gene linked by means of a self-cleaving polypeptide encoding gene, a target sequence B-II; said target sequence B-II comprises more than one (specifically, may be 4) miRNA2 target sequences;

In said expression cassette A-II, both the upstream and downstream of said promoter A have at least one said TALER protein B target, respectively, or the upstream of said promoter A has no said TALER protein B target but the downstream thereof has at least one said TALER protein B target;

In said expression cassette B-II, both the upstream and downstream of said promoter B have at least one said TALER protein A target, respectively, or the upstream of said promoter B has no said TALER protein A target but the downstream thereof has at least one said TALER protein A target;

Said expression cassette C comprises a constitutive promoter- and an activating element-coding sequence successively from upstream to downstream; a DNA positioned downstream of said feedback element coding sequence is expressed under the stimulation of said activating element.

In said expression cassette A-II, the upstream of said promoter A has one said TALER protein B target and the downstream thereof has one to three said TALER protein B targets;

In said expression cassette B-II, the upstream of said promoter B has one said TALER protein A target and the downstream thereof has one to three said TALER protein A targets.

In said expression cassette A-II, the distance between the TALER protein B target upstream of said promoter A and the nearest TALER protein B target downstream of said promoter A is 72-100 bp;

In said expression cassette B-II, the distance between the TALER protein A target upstream of said promoter B and the nearest TALER protein A target downstream of said promoter B is 72-100 bp.

The second method for sorting cell A and/or cell B from mixed cells claimed by the present invention comprises the following steps:

Said cell A has a specific miRNA1-1, . . . , a specific miRNA1-n, wherein n is a natural number of 2 or more;

Said cell B has a specific miRNA2-1, . . . , a specific miRNA2-n, wherein n is a natural number of 2 or more;

A recombinant vector A-II having an expression cassette A-II, a recombinant vector B-II having an expression cassette B-II, and a recombinant vector C having an expression cassette C are introduced into said mixed cells. Said cell A and/or said cell B are sorted by detecting the intensity of a fluorescent protein A and/or a fluorescent protein B; said fluorescent protein A and said fluorescent protein B have different fluorescent colours;

Said expression cassette A-II comprises the following elements successively from upstream to downstream: a feedback element coding sequence, a promoter A, said fluorescent protein A-encoding gene and TALER protein A-encoding gene linked by means of a self-cleaving polypeptide encoding gene, a target sequence A-II; said target sequence A-II comprises a miRNA1-1 target sequence, . . . , a miRNA1-n target sequence, wherein n is a natural number of 2 or more;

Said expression cassette B-II comprises the following elements successively from upstream to downstream: a feedback element coding sequence, a promoter B, said fluorescent protein B-encoding gene and TALER protein B-encoding gene linked by means of a self-cleaving polypeptide encoding gene, a target sequence B-II; said target sequence B-II comprises a miRNA2-1 target sequence, . . . , a miRNA2-n target sequence, wherein n is a natural number of 2 or more;

In said expression cassette A-II, both the upstream and downstream of said promoter A have at least one said TALER protein B target, respectively, or the upstream of said promoter A has no said TALER protein B target but the downstream thereof has at least one said TALER protein B target;

In said expression cassette B-II, both the upstream and downstream of said promoter B have at least one said TALER protein A target, respectively, or the upstream of said promoter B has no said TALER protein A target but the downstream thereof has at least one said TALER protein A target;

Said expression cassette C comprises a constitutive promoter- and an activating element-coding sequence successively from upstream to downstream; a DNA positioned downstream of said feedback element coding sequence is expressed under the stimulation of said activating element.

In said expression cassette A-II, the upstream of said promoter A has one said TALER protein B target and the downstream thereof has one to three said TALER protein B targets;

In said expression cassette B-II, the upstream of said promoter B has one said TALER protein A target and the downstream thereof has one to three said TALER protein A targets.

In said expression cassette A-II, the distance between the TALER protein B target upstream of said promoter A and the nearest TALER protein B target downstream of said promoter A is 72-100 bp;

In said expression cassette B-II, the distance between the TALER protein A target upstream of said promoter B and the nearest TALER protein A target downstream of said promoter B is 72-100 bp.

The third method for sorting cell A and/or cell B from mixed cells claimed by the present invention comprises the following steps:

Said cell A has a specific miRNA1-1, . . . , a specific miRNA1-n, wherein n is a natural number of 2 or more;

Said cell B has a specific miRNA2-1, . . . , a specific miRNA2-n, wherein n is a natural number of 2 or more;

Said cell B has a specific miRNA3-1, . . . , a specific miRNA3-n, wherein n is a natural number of 2 or more;

A recombinant vector A-II having an expression cassette A-II, a recombinant vector B-II having an expression cassette B-II, a recombinant vector C having an expression cassette C and a recombinant vector D-II having an expression cassette D-II are introduced into said mixed cells. Said cell A and/or said cell B are sorted by detecting the intensity of a fluorescent protein A and/or a fluorescent protein B; said fluorescent protein A and said fluorescent protein B have different fluorescent colours;

Said expression cassette A-II comprises the following elements successively from upstream to downstream: a feedback element coding sequence, a promoter A, said fluorescent protein A-encoding gene and TALER protein A-encoding gene linked by means of a self-cleaving polypeptide encoding gene, a target sequence A-II; said target sequence A-II comprises a miRNA1-1 target sequence, . . . , a miRNA1-n target sequence, wherein n is a natural number of 2 or more;

Said expression cassette B-II comprises the following elements successively from upstream to downstream: a feedback element coding sequence, a promoter B, said fluorescent protein B-encoding gene and TALER protein B-encoding gene linked by means of a self-cleaving polypeptide encoding gene, a target sequence B-II; said target sequence B-II comprises a miRNA2-1 target sequence, . . . , a miRNA2-n target sequence, wherein n is a natural number of 2 or more;

Said expression cassette D-II comprises the following elements successively from upstream to downstream: a feedback element coding sequence, a promoter B, said fluorescent protein B-encoding gene and TALER protein B-encoding gene linked by means of a self-cleaving polypeptide encoding gene, a target sequence D-II; said target sequence D-II comprises a miRNA3-1 target sequence, . . . , a miRNA3-n target sequence, wherein n is a natural number of 2 or more;

In said expression cassette A-II, both the upstream and downstream of said promoter A have at least one said TALER protein B target, respectively, or the upstream of said promoter A has no said TALER protein B target but the downstream thereof has at least one said TALER protein B target;

In said expression cassette B-II, both the upstream and downstream of said promoter B have at least one said TALER protein A target, respectively, or the upstream of said promoter B has no said TALER protein A target but the downstream thereof has at least one said TALER protein A target;

In said expression cassette D-II, both the upstream and downstream of said promoter B have at least one said TALER protein A target, respectively, or the upstream of said promoter B has no said TALER protein A target but the downstream thereof has at least one said TALER protein A target;

Said expression cassette C comprises a constitutive promoter- and an activating element-coding sequence successively from upstream to downstream; a DNA positioned downstream of said feedback element coding sequence is expressed under the stimulation of said activating element.

In said expression cassette A-II, the upstream of said promoter A has one said TALER protein B target and the downstream thereof has one to three said TALER protein B targets;

In said expression cassette B-II, the upstream of said promoter B has one said TALER protein A target and the downstream thereof has one to three said TALER protein A targets.

In said expression cassette D-II, the upstream of said promoter B has one said TALER protein A target and the downstream thereof has one to three said TALER protein A targets.

In said expression cassette A-II, the distance between the TALER protein B target upstream of said promoter A and the nearest TALER protein B target downstream of said promoter A is 72-100 bp;

In said expression cassette B-II, the distance between the TALER protein A target upstream of said promoter B and the nearest TALER protein A target downstream of said promoter B is 72-100 bp;

In said expression cassette D-II, the distance between the TALER protein A target upstream of said promoter B and the nearest TALER protein A target downstream of said promoter B is 72-100 bp.

In said expression cassette A-I or said expression cassette A-II, said feedback element coding sequence may specifically be a 5×UAS sequence, and said promoter A may specifically be a CMVmini promoter. In said expression cassette B-I or said expression cassette B-II, said feedback element coding sequence may specifically be a 5×UAS sequence, and said promoter B may specifically be a CMVmini promoter. In said expression cassette C, said constitutive promoter may specifically be a CAG promoter, and said activating element coding sequence may specifically be a Gal4/vp16 encoding gene. In said expression cassette D-I or said expression cassette D-II, said feedback element coding sequence may specifically be a 5×UAS sequence, and said promoter D may specifically be a CMVmini promoter.

Said 5×UAS sequence can be any of said 5×UAS sequence in all of the plasmids containing the 5×UAS sequence involved in Examples 1-6. Said CMVmini promoter can be any of said CMVmini promoter in all of the plasmids containing the CMVmini promoter involved in Examples 1-6. Said CAG promoter can be any of said CAG promoter in all of the plasmids containing CAG promoter involved in Examples 1-6. Said Gal4/vp16 encoding gene can be any of said CAG promoter in all of the plasmids containing the Gal4/vp16 encoding gene involved in Examples 1-6.

Said TALER protein A encoding gene can be any of said TALER protein encoding gene in all of the plasmids containing the TALER protein encoding gene involved in Examples 1-6. Said TALER protein B encoding gene can be any of the of said TALER protein encoding gene in all of the plasmids containing the TALER protein encoding gene involved in Examples 1-6. Said TALER protein A target can be any of said TALER protein target sequence in all of the plasmids containing the TALER protein target sequence involved in Examples 1-6. Said TALER protein B target can be any of said TALER protein target sequence in all of the plasmids containing the TALER protein target sequence involved in Examples 1-6.

Said self-cleaving polypeptide encoding gene (also known as 2A linking peptide) encoding gene can be the 2A linking peptide encoding gene and the self-cleaving polypeptide encoding gene in any of said plasmids in Examples 1-6.

Said fluorescent protein A may specifically be mKate2 or EYFP. Said fluorescent protein B may specifically be mKate2 or EYFP. Said mKate2 encoding gene can be any of said mKate2 encoding gene in all of the plasmids containing the mKate2 encoding gene involved in Examples 1-6. Said EYFP encoding gene can be any of said EYFP encoding gene in all of the plasmids containing the EYFP encoding gene involved in Examples 1-6.

Said shRNA1 target sequence may specifically be a shRNA-FF3 target sequence, a shRNA-FF4 target sequence, a shRNA-FF5 target sequence or a shRNA-FF6 target sequence. Said shRNA2 target sequence may specifically be a shRNA-FF3 target sequence, a shRNA-FF4 target sequence, a shRNA-FF5 target sequence or a shRNA-FF6 target sequence. Said shRNA1-1 target sequence, ..., said shRNA1-n target sequence, said shRNA2-1 target sequence, ..., said shRNA2-n target sequence, said shRNA2-1 target sequence, ..., or said shRNA2-n target sequence may specifically be a shRNA-FF3 target sequence, a shRNA-FF4 target sequence, a shRNA-FF5 target sequence or a shRNA-FF6 target sequence. Said shRNA-FF3 target sequence may specifically be the shRNA-FF3 target sequence in any of said plasmids in Examples 1-6. Said shRNA-FF4 target sequence may specifically be the shRNA-FF4 target sequence in any of said plasmids in Examples 1-6. Said shRNA-FF5 target sequence may specifically be the shRNA-FF5 target sequence in any of said plasmids in Examples 1-6. Said shRNA-FF6 target sequence may specifically be the shRNA-FF6 target sequence in any of said plasmids in Examples 1-6.

Said shRNA1 may specifically be the RNA encoded by a shRNA-FF3 encoding gene, the RNA encoded by a shRNA-FF4 encoding gene, the RNA encoded by a shRNA-FF5 encoding gene or the RNA encoded by a shRNA-FF6 encoding gene. Said shRNA2 may specifically be the RNA encoded by a shRNA-FF3 encoding gene, the RNA encoded by a shRNA-FF4 encoding gene, the RNA encoded by a shRNA-FF5 encoding gene or the RNA encoded by a shRNA-FF6 encoding gene. Said shRNA3 may specifically be the RNA encoded by a shRNA-FF3 encoding gene, the RNA encoded by a shRNA-FF4 encoding gene, the RNA encoded by a shRNA-FF5 encoding gene or the RNA encoded by a shRNA-FF6 encoding gene. Said shRNA-FF3 encoding gene may specifically be the shRNA-FF3 encoding gene in any of said plasmids in Examples 1-6. Said shRNA-FF4 encoding gene may specifically be the shRNA-FF4 encoding gene in any of said plasmids in Examples 1-6. Said shRNA-FF5 encoding gene may specifically be the shRNA-FF5 encoding gene in any of said plasmids in Examples 1-6. Said shRNA-FF6 encoding gene may specifically be the shRNA-FF6 encoding gene in any of said plasmids in Examples 1-6.

Said miRNA1 target sequence may specifically be a miR21 target sequence, a miR18a target sequence, a miR19ab target sequence or a miR191 target sequence. Said miRNA2 target sequence may specifically be a miR21 target sequence, a miR18a target sequence, a miR19ab target sequence or a miR191 target sequence. Said miRNA1-1 target sequence, ..., miRNA1-n target sequence, miRNA2-1 target sequence, ..., miRNA2-n target sequence, miRNA3-1 target sequence, ..., miRNA3-n target sequence may specifically be a miR21 target sequence, a miR18a target sequence, a miR19ab target sequence or a miR191 target sequence. Said miR21 target sequence may specifically be the miR21 target sequence in any of the plasmids in Examples 1-6. Said miR18a target sequence may specifically be the miR18a target sequence in any of the plasmids in Examples 1-6. Said miR19ab target sequence may specifically be the miR19ab target sequence in any of the plasmids in Examples 1-6. Said miR191 target sequence may specifically be the miR191 target sequence in any of the plasmids in Examples 1-6.

Said recombinant vector C may specifically be pCAG-Gal4/vp16-2A-TagBFP-2A-B1a plasmid or pCAG-Gal4/vp16 plasmid.

Said recombinant vector A-I may specifically be
pT9+T9x3+72-mKate2-2A-TALER10-4xTarget^FF4 plasmid,
pT9+T9x3+72-mKate2-2A-TALER12-4xTarget^FF6 plasmid,
pT9+T9x3+72-mKate2-2A-TALER14-4xTarget^FF4 plasmid,
pT9+T9x3+72-mKate2-2A-TALER21-4xTarget^FF3 plasmid,
pT10+T10x3+72-EYFP-2A-TALER9-4xTarget^FF5 plasmid,
pT10+T10x3+72-mKate2-2A-TALER12-4xTarget^FF6 plasmid,
pT10+T10x3+72-mKate2-2A-TALER14-4xTarget^FF4 plasmid,
pT10+T10x3+72-mKate2-2A-TALER14-4xTarget^FF5 plasmid, pT10+T10x3+72-mKate2-2A-TALER21-4xTarget^FF3 plasmid,
pT12+T12x3+72-EYFP-2A-TALER9-4xTarget^FF5 plasmid,
pT12+T12x3+72-EYFP-2A-TALER10-4xTarget^FF4 plasmid,
pT12+T12x3+72-mKate2-2A-TALER14-4xTarget^FF4 plasmid,
pT12+T12x3+72-mKate2-2A-TALER21-4xTarget^FF3 plasmid,
pT14+T14x3+72-EYFP-2A-TALER9-4xTarget^FF5 plasmid,
pT14+T14x3+72-EYFP-2A-TALER12-4xTarget^FF5 plasmid,
pT14+T14x3+72-mKate2-2A-TALER21-4xTarget^FF3 plasmid,
pT21+T21x3+72-EYFP-2A-TALER14-4xTarget^FF4 plasmid,
pT21+T21x3+72-EYFP-2A-TALER9-4xTarget^FF5 plasmid,
pT21+T21x3+72-EYFP-2A-TALER10-4xTarget^FF4 plasmid,
pT21+T21x3+72-EYFP-2A-TALER12-4xTarget^FF5 plasmid,
pT14+T14x3+72-EYFP-2A-TALER10-4xTarget^FF4 plasmid or
pT9+T9x3+72-mKate2-2A-TALER14-4xTarget^FF5 plasmid in Examples.

Said recombinant vector B-I may specifically be
pT9+T9x3+72-mKate2-2A-TALER10-4xTarget^FF4 plasmid,
pT9+T9x3+72-mKate2-2A-TALER12-4xTarget^FF6 plasmid,
pT9+T9x3+72-mKate2-2A-TALER14-4xTarget^FF4 plasmid,
pT9+T9x3+72-mKate2-2A-TALER21-4xTarget^FF3 plasmid,
pT10+T10x3+72-EYFP-2A-TALER9-4xTarget^FF5 plasmid,
pT10+T10x3+72-mKate2-2A-TALER12-4xTarget^FF6 plasmid,
pT10+T10x3+72-mKate2-2A-TALER14-4xTarget^FF4 plasmid,
pT10+T10x3+72-mKate2-2A-TALER14-4xTarget^FF5 plasmid,
pT10+T10x3+72-mKate2-2A-TALER21-4xTarget^FF3 plasmid,
pT12+T12x3+72-EYFP-2A-TALER9-4xTarget^FF5 plasmid,
pT12+T12x3+72-EYFP-2A-TALER10-4xTarget^FF4 plasmid,
pT12+T12x3+72-mKate2-2A-TALER14-4xTarget^FF4 plasmid,
pT12+T12x3+72-mKate2-2A-TALER21-4xTarget^FF3 plasmid,
pT14+T14x3+72-EYFP-2A-TALER9-4xTarget^FF5 plasmid,
pT14+T14x3+72-EYFP-2A-TALER12-4xTarget^FF5 plasmid,
pT14+T14x3+72-mKate2-2A-TALER21-4xTarget^FF3 plasmid,
pT21+T21x3+72-EYFP-2A-TALER14-4xTarget^FF4 plasmid,
pT21+T21x3+72-EYFP-2A-TALER9-4xTarget^FF5 plasmid,
pT21+T21x3+72-EYFP-2A-TALER10-4xTarget^FF4 plasmid,
pT21+T21x3+72-EYFP-2A-TALER12-4xTarget^FF5 plasmid,
pT14+T14x3+72-EYFP-2A-TALER10-4xTarget^FF4 plasmid or
pT9+T9x3+72-mKate2-2A-TALER14-4xTarget^FF5 plasmid in Examples.

Said host cells may specifically be HEK293 cells, HeLa cells, HeLa: TagBFP or HEK293: iRFP_shRNA-FF4.

By modifying the mammalian cell line with the tetracycline (Dox)-inducing system, the inventors demonstrated that the inhibitory regulation of gene expression by TALER protein is reversible and has a relatively rapid dynamic response. The inventors also developed a mathematical model that quantitatively predicts the steady state of the cascaded TALER and the TALER switch constructed by two mutually-inhibited TALER solely based on individual TALER input/output transfer functions measured by the inventors. In addition, the inventors showed that a TALER switch with a closed-loop structure has a better sensitivity to synthesized short hairpin RNA (shRNA) signals than a TALER switch with an open-loop structure. Finally, the inventors constructed TALER switches regulated by cell-specific microRNAs in a mixed cell population which show different outputs for two co-cultured cancer cells and significantly improve the accuracy of classification. Overall, these experimental results show that the inventors provided a series of orthogonal, reversible TALER element libraries that can serve as standardized genetic elements for modular assembly of synthetic gene circuits in mammalian cells and have predictable programmable features. The inventors' results also show that the TALER switches can be applied to in vitro biotechnologies with the need of precise cell classification, which has important association with many biomedical applications such as genetic therapy of cancers. In addition, these TALER elements also contribute to the construction of synthetic network motifs to explore design principles of combined transcriptional and microRNA-mediated post-transcriptional regulation in mammalian cells.

Engineered construction of sophisticated gene circuits is hampered by the lack of orthogonal and reversible transcriptional repression elements. Herein the inventors exhibited rapid, engineered construction of reversible and orthogonal TALE repressors and their corresponding promoters in mammalian cells for transcriptional repression utilizing steric hindrance. The top 10 most potent TALERs are effective in repressing their corresponding promoters but have little effect on the other nine promoters. Given the modularization of various repeat variable di-residues (RVDs) of TALE, TALER libraries can be easily constructed and extended using high-throughput cloning methods. It is also possible to inhibit the transcription of structurally defined endogenous gene promoter using TALER steric hindrance.

Synthetic biology aims to modularly construct clearly-defined synthetic gene circuits using engineering principles. However, in the gene circuits in mammalian cells, synthesizing their components, quantitatively describing and predicting their functions are still important challenges. In the inventors' work, the input and output levels of TALER elements were measured simultaneously using a multi-fluorescent Dox inducing system and a colour model that can normalize input and output fluorescence levels was established. Through experiment-based input/output transfer functions, the inventors found that some TALER properties can be used to construct TALER cascades and switches and be capable of quantitatively predicting their results. In addition, more accurate predictions may require further characteristic test and modelling. For example, classification analysis may help eliminating copy number differences in transient transfection. It is also necessary to consider the dynamic characteristics of TALER to improve the accuracy of prediction for a variety of other gene circuit motifs.

It has been demonstrated that feedback and feedforward patterns play an important role in coordinating transcriptional and post-transcriptional regulation of gene expression. However, the research and understanding of a core transcriptional regulation pattern is often hampered by undesired mutual regulations in natural genetic networks. A series of orthogonal, well-defined TALER libraries of inventors are a valuable tool for constructing a gene circuit containing transcriptional and post-transcriptional regulations. For example, the inventors demonstrated that a closed-loop TALER switch has a superior state transition at the input of a corresponding shRNA compared to an open-loop TALER switch. It has been shown that one of the three minimum core patterns which can generate a spontaneous polarity on a cell membrane contains a mutually inhibitory regulation. Similarly, the inventors evaluated the effect of different topologies on the performance of TALER switches by adding or removing positive and negative feedbacks, which helps to better understand the design principles of highly stable TALER switches.

The gene circuits that can sense multiple endogenous molecular signals may make complex operations on living cells. RNA interference provides a channel, a modularization, and an extensible interface between synthetic gene circuits and endogenous molecular inputs in mammalian cells. In the present invention, the inventors indicated that endogenous microRNAs can be used to control the state of TALER switches, and the sensitivity of TALER switches to shRNA regulation can be adjusted by adjusting the ratio of two components. The inventors also indicated that microRNAs specific to two cell types can strictly control the output of TALER switches and thus achieve accurate cell classification in a mixed cell population. Thus, the research results of the inventors facilitate the selection of TALER switch construction that can sense cell-specific microRNAs, and appropriate TALERs can be selected directly from the TALER libraries to meet the needs of different expression levels. In addition, TALER switches can be used to modularly construct more sophisticated logic gene circuits, such as by using a logic design framework, to more accurately probe cell type specific microRNAs, or for programmable memory elements to track intracellular events and signalling processes. TALER switches will be widely applied in biomedicine in the future as long as the conditions such as highly effective in vivo cell delivery and long-term functional stability of gene circuits are addressed.

BEST MODE FOR IMPLEMENTING THE INVENTION

Figure 1:
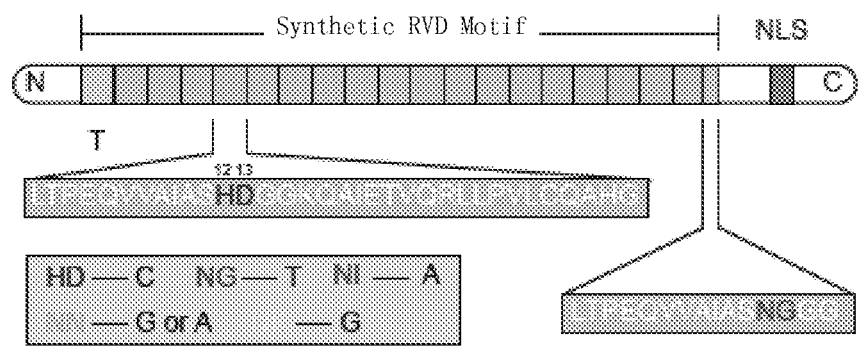
FIG. 1 is a schematic diagram of the action mechanism of TALER protein. TALER protein "protein module", SEQ ID NO: 133; C-terminal sequence, SEQ ID NO: 134.

The following examples are provided to facilitate a better understanding of the present invention, but are not intended to limit the invention. The experimental methods in the following examples are all conventional methods, unless specified otherwise. The experimental materials used in the following examples are commercially available from conventional biochemical reagents stores, unless otherwise specified. The quantitative experiments in the following examples are conducted in three independent repetitions, and the results are averaged. HEK293 cells: from Invitrogen company. The schematic diagram of action mechanism of TALER proteins is shown in FIG. 1.

The method of cell transfection with plasmids in Example 1 and Example 2 is as follows: take a 24-well plate; 0.5 mL of HEK293 cell suspension (containing $6 \times 10^4$ HEK293 cells) is seeded into each well; after 24 hours of culture, replace with fresh DMEM culture medium; then transfect plasmids.

Example 1. Functional Verification and Specificity Analysis of TALER Proteins

Figure 2:
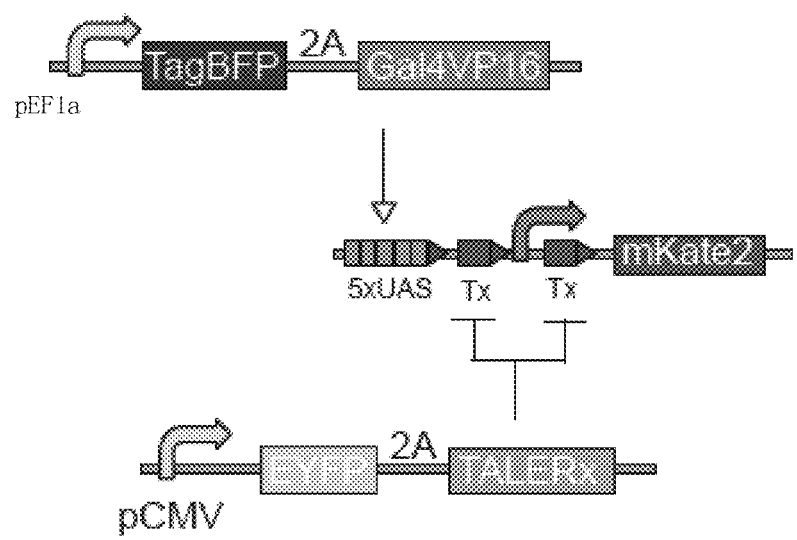
FIG. 2 is a schematic diagram of the action mechanism of pCMV-TALERx plasmids, pTx+Tx+ plasmids and pEF1a-TagBFP-2A plasmids.

The schematic diagrams of action mechanisms of pCMV-TALERx plasmid, pTx+Tx+ plasmid and pEF1a-TagBFP-2A plasmid are shown in FIG. 2. TagBFP and Gal4/vp16 were expressed under the effect of pEF1a promoter (the 2A linking peptide between TagBFP and Gal4/vp16 is a self-cleaving peptide, so TagBFP could represent the quantity of Gal4/vp16 expression). Gal4/vp16 activated the 5×UAS sequence, thereby the transcription initiation of the CMVmini promoter were activated, and mKate2 was expressed. EYFP and TALER1 proteins were expressed under the effect of the CMV promoter (the 2A linking peptide between EYFP and TALER1 proteins is a self-cleaving peptide, so EYFP could represent the amount of TALER1 protein expression). The TALER1 protein binding to T1 sequence played a role of a transcriptional repression by steric hindrance, and the CMVmini promoter between two T1 sequences was inactivated and the expression of mKate2 was inhibited.

The pCMV-TALER1 plasmid is as shown in SEQ ID NO: 1. In the SEQ ID NO: 1, from the 5' end it contains a CMV promoter at nucleotides 1-589, a EYFP (enhanced yellow fluorescent protein) encoding gene at nucleotides 603-1319, a 2A linking peptide encoding gene at nucleotides 1326-1379, a TALER1 protein encoding gene at nucleotides 1389-4220, and a nuclear localization signal SV40NLS encoding gene at nucleotides 4227-4259.

The pT1+T1+ plasmid is as shown in SEQ ID NO: 27. In the SEQ ID NO: 27, from the 5' end it contains a 5×UAS sequence at nucleotides 4275-4367, a T1 sequence (TALER1 protein target sequence) at nucleotides 4383-4396, a CMVmini promoter at nucleotides 4403-4462, a T1 sequence at nucleotides 4469-4482, and a mKate2 (far-infrared fluorescent protein) encoding gene at nucleotides 4532-5237.

The pEF1a-TagBFP-2A plasmid is as shown in SEQ ID NO: 53. In the SEQ ID NO: 53, from the 5' end it contains a pEF1a (promoter) at nucleotides 4250-5423, a TagBFP (blue fluorescent protein) encoding gene at nucleotides 5488-6177, a 2A linking peptide encoding gene at nucleotides 6178-6243, a Gal4/vp16 (fusion transcription factor) encoding gene at nucleotides 6250-6933.

The pCMV-TALER2 plasmid is as shown in SEQ ID NO: 2. In the SEQ ID NO: 2, it comprises a CMV promoter at nucleotides 1-589, a EYFP encoding gene at nucleotides 603-1319, a 2A linking peptide encoding gene at nucleotides 1326-1379, a TALER2 protein encoding gene at nucleotides 1389-4220, and a nuclear localization signal SV40NLS encoding gene at nucleotides 4227-4259.

The pCMV-TALER4 plasmid is as shown in SEQ ID NO: 3. In the SEQ ID NO: 3, it comprises a CMV promoter at nucleotides 1713-2301, a EYFP encoding gene at nucleotides 2315-3031, a 2A linking peptide encoding gene at nucleotides 3038-3091, a TALER4 protein encoding gene at nucleotides 3101-5932, and a nuclear localization signal SV40NLS encoding gene at nucleotides 5939-5971.

The pCMV-TALER 5 plasmid is as shown in SEQ ID NO: 4. In the SEQ ID NO: 4, it comprises a CMV promoter at nucleotides 5842-6430, a EYFP encoding gene at nucleotides 6444-7160, a 2A linking peptide encoding gene at nucleotides 7167-7220, a TALER5 protein encoding gene at nucleotides 7230-2387, and a nuclear localization signal SV40NLS encoding gene at nucleotides 2394-2426.

The pCMV-TALER9 plasmid is as shown in SEQ ID NO: 5. In the SEQ ID NO: 5, it comprises a CMV promoter at nucleotides 6148-6736, a EYFP encoding gene at nucleotides 6750-7466, a 2A linking peptide encoding gene at nucleotides 7473-7526, a TALER9 protein encoding gene at nucleotides 7536-2693, and a nuclear localization signal SV40NLS encoding gene at nucleotides 2700-2732.

The pCMV-TALER10 plasmid is as shown in SEQ ID NO: 6. In the SEQ ID NO: 6, it comprises a CMV promoter at nucleotides 1792-2380, a EYFP encoding gene at nucleotides 2394-3110, a 2A linking peptide encoding gene at nucleotides 3117-3170, a TALER10 protein encoding gene at nucleotides 3180-6623, and a nuclear localization signal SV40NLS encoding gene at nucleotides 6630-6662.

The pCMV-TALER11 plasmid is as shown in SEQ ID NO: 7. In the SEQ ID NO: 7, it comprises a CMV promoter at nucleotides 1766-2354, a EYFP encoding gene at nucleotides 2368-3084, a 2A linking peptide encoding gene at nucleotides 3091-3144, a TALER11 protein encoding gene at nucleotides 3154-6597, and a nuclear localization signal SV40NLS encoding gene at nucleotides 6604-6636.

The pCMV-TALER12 plasmid is as shown in SEQ ID NO: 8. In the SEQ ID NO: 8, it comprises a CMV promoter at nucleotides 1705-2293, a EYFP encoding gene at nucleotides 2307-3023, a 2A linking peptide encoding gene at nucleotides 3030-3083, a TALER12 protein encoding gene at nucleotides 3093-6332, and a nuclear localization signal SV40NLS encoding gene at nucleotides 6339-6371.

The pCMV-TALER13 plasmid is as shown in SEQ ID NO: 9. In the SEQ ID NO: 9, it comprises a CMV promoter at nucleotides 1687-2275, a EYFP encoding gene at nucleotides 2289-3005, a 2A linking peptide encoding gene at nucleotides 3012-3065, a TALER13 protein encoding gene at nucleotides 3075-6212, and a nuclear localization signal SV40NLS encoding gene at nucleotides 6219-6251.

The pCMV-TALER14 plasmid is as shown in SEQ ID NO: 10. In the SEQ ID NO: 10, it comprises a CMV promoter at nucleotides 1764-2352, a EYFP encoding gene at nucleotides 2366-3082, a 2A linking peptide encoding gene at nucleotides 3089-3142, a TALER14 protein encoding gene at nucleotides 3152-6289, and a nuclear localization signal SV40NLS encoding gene at nucleotides 6296-6328.

The pCMV-TALER15 plasmid is as shown in SEQ ID NO: 11. In the SEQ ID NO: 11, it comprises a CMV promoter at nucleotides 1-589, a EYFP encoding gene at nucleotides 603-1319, a 2A linking peptide encoding gene at nucleotides 1326-1379, a TALER15 protein encoding gene at nucleotides 1394-4597, and a nuclear localization signal SV40NLS encoding gene at nucleotides 4605-4637.

The pCMV-TALER16 plasmid is as shown in SEQ ID NO: 12. In the SEQ ID NO: 12, it comprises a CMV promoter at nucleotides 1-589, a EYFP encoding gene at nucleotides 603-1319, a 2A linking peptide encoding gene at nucleotides 1326-1379, a TALER16 protein encoding gene at nucleotides 1394-4597, and a nuclear localization signal SV40NLS encoding gene at nucleotides 4605-4637.

The pCMV-TALER17 plasmid is as shown in SEQ ID NO: 13. In the SEQ ID NO: 13, it comprises a CMV promoter at nucleotides 1-589, a EYFP encoding gene at nucleotides 603-1319, a 2A linking peptide encoding gene at nucleotides 1326-1379, a TALER17 protein encoding gene at nucleotides 1394-4597, and a nuclear localization signal SV40NLS encoding gene at nucleotides 4605-4637.

The pCMV-TALER18 plasmid is as shown in SEQ ID NO: 14. In the SEQ ID NO: 14, it comprises a CMV promoter at nucleotides 1-589, a EYFP encoding gene at nucleotides 603-1319, a 2A linking peptide encoding gene at nucleotides 1326-1379, a TALER18 protein encoding gene at nucleotides 1394-4597, and a nuclear localization signal SV40NLS encoding gene at nucleotides 4605-4637.

The pCMV-TALER19 plasmid is as shown in SEQ ID NO: 15. In the SEQ ID NO: 15, it comprises a CMV promoter at nucleotides 1711-2299, a EYFP encoding gene at nucleotides 2313-3029, a 2A linking peptide encoding gene at nucleotides 3036-3089, a TALER19 protein encoding gene at nucleotides 3099-6440, and a nuclear localization signal SV40NLS encoding gene at nucleotides 6447-6479.

The pCMV-TALER20 plasmid is as shown in SEQ ID NO: 16. In the SEQ ID NO: 16, it comprises a CMV promoter at nucleotides 1-589, a EYFP encoding gene at nucleotides 603-1319, a 2A linking peptide encoding gene at nucleotides 1326-1379, a TALER20 protein encoding gene at nucleotides 1394-4597, and a nuclear localization signal SV40NLS encoding gene at nucleotides 4605-4637.

The pCMV-TALER21 plasmid is as shown in SEQ ID NO: 17. In the SEQ ID NO: 17, it comprises a CMV promoter at nucleotides 1616-2204, a EYFP encoding gene at nucleotides 2218-2934, a 2A linking peptide encoding gene at nucleotides 2941-2994, a TALER21 protein encoding gene at nucleotides 3004-6345, and a nuclear localization signal SV40NLS encoding gene at nucleotides 6352-6384.

The pCMV-TALER22 plasmid is as shown in SEQ ID NO: 18. In the SEQ ID NO: 18, it comprises a CMV promoter at nucleotides 1-589, a EYFP encoding gene at nucleotides 603-1319, a 2A linking peptide encoding gene at nucleotides 1326-1379, a TALER22 protein encoding gene at nucleotides 1394-3985, and a nuclear localization signal SV40NLS encoding gene at nucleotides 3993-4025.

The pCMV-TALER23 plasmid is as shown in SEQ ID NO: 19. In the SEQ ID NO: 19, it comprises a CMV promoter at nucleotides 1-589, a EYFP encoding gene at nucleotides 603-1319, a 2A linking peptide encoding gene at nucleotides 1326-1379, a TALER23 protein encoding gene at nucleotides 1394-3985, and a nuclear localization signal SV40NLS encoding gene at nucleotides 3993-4025.

The pCMV-TALER24 plasmid is as shown in SEQ ID NO: 20. In the SEQ ID NO: 20, it comprises a CMV promoter at nucleotides 1-589, a EYFP encoding gene at nucleotides 603-1319, a 2A linking peptide encoding gene at nucleotides 1326-1379, a TALER24 protein encoding gene at nucleotides 1394-3985, and a nuclear localization signal SV40NLS encoding gene at nucleotides 3993-4025.

The pCMV-TALER26 plasmid is as shown in SEQ ID NO: 21. In the SEQ ID NO: 21, it comprises a CMV promoter at nucleotides 1679-2267, a EYFP encoding gene at nucleotides 2281-2997, a 2A linking peptide encoding gene at nucleotides 3004-3057, a TALER26 protein encoding gene at nucleotides 3064-6009, and a nuclear localization signal SV40NLS encoding gene at nucleotides 6024-6045.

The pCMV-TALER29 plasmid is as shown in SEQ ID NO: 22. In the SEQ ID NO: 22, it comprises a CMV promoter at nucleotides 1638-2226, a EYFP encoding gene at nucleotides 2240-2956, a 2A linking peptide encoding gene at nucleotides 2963-3016, a TALER29 protein encoding gene at nucleotides 3023-5560, and a nuclear localization signal SV40NLS encoding gene at nucleotides 5575-5596.

The pCMV-TALER30 plasmid is as shown in SEQ ID NO: 23. In the SEQ ID NO: 23, it comprises a CMV promoter at nucleotides 1838-2426, a EYFP encoding gene at nucleotides 2440-3156, a 2A linking peptide encoding gene at nucleotides 3163-3216, a TALER30 protein encoding gene at nucleotides 3223-5760, and a nuclear localization signal SV40NLS encoding gene at nucleotides 5775-5796.

The pCMV-TALER31 plasmid is as shown in SEQ ID NO: 24. In the SEQ ID NO: 24, it comprises a CMV promoter at nucleotides 3403-3991, a EYFP encoding gene at nucleotides 4005-4721, a 2A linking peptide encoding gene at nucleotides 4728-4781, a TALER31 protein encoding gene at nucleotides 4788-7325, and a nuclear localization signal SV40NLS encoding gene at nucleotides 7340-7361.

The pCMV-TALER32 plasmid is as shown in SEQ ID NO: 25. In the SEQ ID NO: 25, it comprises a CMV promoter at nucleotides 1691-2279, a EYFP encoding gene at nucleotides 2293-3009, a 2A linking peptide encoding gene at nucleotides 3016-3069, a TALER32 protein encoding gene at nucleotides 3076-5613, and a nuclear localization signal SV40NLS encoding gene at nucleotides 5628-5649.

The pCMV-TALER35 plasmid is as shown in SEQ ID NO: 26. In the SEQ ID NO: 26, it comprises a CMV promoter at nucleotides 1607-2195, a EYFP encoding gene at nucleotides 2209-2925, a 2A linking peptide encoding gene at nucleotides 2932-2985, a TALER35 protein encoding gene at nucleotides 2992-5529, and a nuclear localization signal SV40NLS encoding gene at nucleotides 5544-5565.

The pT2+T2+ plasmid is as shown in SEQ ID NO: 28. In the SEQ ID NO: 28, from the 5' end it comprises a 5×UAS sequence at nucleotides 69-161, a T2 sequence (TALER2 protein target sequence) at nucleotides 177-190, a CMVmini promoter at nucleotides 197-256, a T2 sequence at nucleotides 263-276, and a mKate2 encoding gene at nucleotides 355-1073.

The pT4+T4+ plasmid is as shown in SEQ ID NO: 29. In the SEQ ID NO: 29, from the 5' end it comprises a 5×UAS sequence at nucleotides 69-161, a T4 sequence (TALER4 protein target sequence) at nucleotides 177-190, a CMVmini promoter at nucleotides 197-256, a T4 sequence at nucleotides 263-276, and a mKate2 encoding gene at nucleotides 355-1073.

The pT5+T5+ plasmid is as shown in SEQ ID NO: 30. In the SEQ ID NO: 30, from the 5' end it comprises a 5×UAS sequence at nucleotides 69-161, a T5 sequence (TALER5 protein target sequence) at nucleotides 177-194, a CMVmini promoter at nucleotides 201-260, a T5 sequence at nucleotides 267-284, and a mKate2 encoding gene at nucleotides 363-1081.

The pT9+T9+ plasmid is as shown in SEQ ID NO: 31. In the SEQ ID NO: 31, from the 5' end it comprises a 5×UAS sequence at nucleotides 69-161, a T9 sequence (TALER9 protein target sequence) at nucleotides 177-197, a CMVmini promoter at nucleotides 204-263, a T9 sequence at nucleotides 270-290, and a mKate2 encoding gene at nucleotides 369-1087.

The pT10+T10+ plasmid is as shown in SEQ ID NO: 32. In the SEQ ID NO: 32, from the 5' end it comprises a 5×UAS sequence at nucleotides 7069-7161, a T10 sequence (TALER10 protein target sequence) at nucleotides 7177-7196, a CMVmini promoter at nucleotides 7203-7262, a T10 sequence at nucleotides 7269-7288, and a mKate2 encoding gene at nucleotides 78-796.

The pT11+T11+ plasmid is as shown in SEQ ID NO: 33. In the SEQ ID NO: 33, from the 5' end it comprises a 5×UAS sequence at nucleotides 69-161, a T11 sequence (TALER11 protein target sequence) at nucleotides 177-196, a CMVmini promoter at nucleotides 203-262, a T11 sequence at nucleotides 269-288, and a mKate2 encoding gene at nucleotides 367-1085.

The pT12+T12+ plasmid is as shown in SEQ ID NO: 34. In the SEQ ID NO: 34, from the 5' end it comprises a 5×UAS sequence at nucleotides 7069-7161, a T12 sequence (TALER12 protein target sequence) at nucleotides 7177-7194, a CMVmini promoter at nucleotides 7201-7260, a T12 sequence at nucleotides 7267-7284, and a mKate2 encoding gene at nucleotides 78-796.

The pT13+T13+ plasmid is as shown in SEQ ID NO: 35. In the SEQ ID NO: 35, from the 5' end it comprises a 5×UAS sequence at nucleotides 7069-7161, a T13 sequence (TALER13 protein target sequence) at nucleotides 7177-7193, a CMVmini promoter at nucleotides 7200-7259, a T13 sequence at nucleotides 7266-7282, and a mKate2 encoding gene at nucleotides 78-796.

The pT14+T14+ plasmid is as shown in SEQ ID NO: 36. In the SEQ ID NO: 36, from the 5' end it comprises a 5×UAS sequence at nucleotides 7069-7161, a T14 sequence (TALER14 protein target sequence) at nucleotides 7177-7193, a CMVmini promoter at nucleotides 7200-7259, a T14 sequence at nucleotides 7266-7282, and a mKate2 encoding gene at nucleotides 78-796.

The pT15+T15+ plasmid is as shown in SEQ ID NO: 37. In the SEQ ID NO: 37, from the 5' end it comprises a 5×UAS sequence at nucleotides 69-161, a T15 sequence (TALER15 protein target sequence) at nucleotides 177-201, a CMVmini promoter at nucleotides 208-267, a T15 sequence at nucleotides 274-298, and a mKate2 encoding gene at nucleotides 377-1095.

The pT16+T16+ plasmid is as shown in SEQ ID NO: 38. In the SEQ ID NO: 38, from the 5' end it comprises a 5×UAS sequence at nucleotides 69-161, a T16 sequence (TALER16 protein target sequence) at nucleotides 177-201, a CMVmini promoter at nucleotides 208-267, a T16 sequence at nucleotides 274-298, and a mKate2 encoding gene at nucleotides 377-1095.

The pT17+T17+ plasmid is as shown in SEQ ID NO: 39. In the SEQ ID NO: 39, from the 5' end it comprises a 5×UAS sequence at nucleotides 69-161, a T17 sequence (TALER17 protein target sequence) at nucleotides 177-201, a CMVmini promoter at nucleotides 208-267, a T17 sequence at nucleotides 274-298, and a mKate2 encoding gene at nucleotides 377-1095.

The pT18+T18+ plasmid is as shown in SEQ ID NO: 40. In the SEQ ID NO: 40, from the 5' end it comprises a 5×UAS sequence at nucleotides 69-161, a T18 sequence (TALER18 protein target sequence) at nucleotides 177-201, a CMVmini promoter at nucleotides 208-267, a T18 sequence at nucleotides 274-298, and a mKate2 encoding gene at nucleotides 377-1095.

The pT19+T19+ plasmid is as shown in SEQ ID NO: 41. In the SEQ ID NO: 41, from the 5' end it comprises a 5×UAS sequence at nucleotides 7069-7161, a T19 sequence (TALER19 protein target sequence) at nucleotides 7177-7195, a CMVmini promoter at nucleotides 7202-7261, a T19 sequence at nucleotides 7268-7286, and a mKate2 encoding gene at nucleotides 78-796.

The pT20+T20+ plasmid is as shown in SEQ ID NO: 42. In the SEQ ID NO: 42, from the 5' end it comprises a 5×UAS sequence at nucleotides 69-161, a T20 sequence (TALER20 protein target sequence) at nucleotides 177-201, a CMVmini promoter at nucleotides 208-267, a T20 sequence at nucleotides 274-298, and a mKate2 encoding gene at nucleotides 377-1095.

The pT21+T21+ plasmid is as shown in SEQ ID NO: 43. In the SEQ ID NO: 43, from the 5' end it comprises a 5×UAS sequence at nucleotides 7069-7161, a T21 sequence (TALER21 protein target sequence) at nucleotides 7177-7195, a CMVmini promoter at nucleotides 7202-7261, a T21 sequence at nucleotides 7268-7286, and a mKate2 encoding gene at nucleotides 78-796.

The pT22+T22+ plasmid is as shown in SEQ ID NO: 44. In the SEQ ID NO: 44, from the 5' end it comprises a 5×UAS sequence at nucleotides 69-161, a T22 sequence (TALER22 protein target sequence) at nucleotides 177-195, a CMVmini promoter at nucleotides 202-261, a T22 sequence at nucleotides 268-286, and a mKate2 encoding gene at nucleotides 365-1083.

The pT23+T23+ plasmid is as shown in SEQ ID NO: 45. In the SEQ ID NO: 45, from the 5' end it comprises a 5×UAS sequence at nucleotides 69-161, a T23 sequence (TALER23 protein target sequence) at nucleotides 177-195, a CMVmini promoter at nucleotides 202-261, a T23 sequence at nucleotides 268-286, and a mKate2 encoding gene at nucleotides 365-1083.

The pT24+T24+ plasmid is as shown in SEQ ID NO: 46. In the SEQ ID NO: 46, from the 5' end it comprises a 5×UAS sequence at nucleotides 69-161, a T24 sequence (TALER24 protein target sequence) at nucleotides 177-195, a CMVmini promoter at nucleotides 202-261, a T24 sequence at nucleotides 268-286, and a mKate2 encoding gene at nucleotides 365-1083.

The pT26+T26+ plasmid is as shown in SEQ ID NO: 47. In the SEQ ID NO: 47, from the 5' end it comprises a 5×UAS sequence at nucleotides 69-161, a T26 sequence (TALER26 protein target sequence) at nucleotides 177-194, a CMVmini promoter at nucleotides 201-260, a T26 sequence at nucleotides 267-284, and a mKate2 encoding gene at nucleotides 363-1081.

The pT29+T29+ plasmid is as shown in SEQ ID NO: 48. In the SEQ ID NO: 48, from the 5' end it comprises a 5×UAS sequence at nucleotides 69-161, a T29 sequence (TALER29 protein target sequence) at nucleotides 177-190, a CMVmini promoter at nucleotides 197-256, a T29 sequence at nucleotides 263-276, and a mKate2 encoding gene at nucleotides 355-1073.

The pT30+T30+ plasmid is as shown in SEQ ID NO: 49. In the SEQ ID NO: 49, from the 5' end it comprises a 5×UAS sequence at nucleotides 69-161, a T30 sequence (TALER30 protein target sequence) at nucleotides 177-190, a CMVmini promoter at nucleotides 197-256, a T30 sequence at nucleotides 263-276, and a mKate2 encoding gene at nucleotides 355-1073.

The pT31+T31+ plasmid is as shown in SEQ ID NO: 50. In the SEQ ID NO: 50, from the 5' end it comprises a 5×UAS sequence at nucleotides 69-161, a T31 sequence (TALER31 protein target sequence) at nucleotides 177-189, a CMVmini promoter at nucleotides 196-255, a T31 sequence at nucleotides 262-274, and a mKate2 encoding gene at nucleotides 353-1071.

The pT32+T32+ plasmid is as shown in SEQ ID NO: 51. In the SEQ ID NO: 51, from the 5' end it comprises a 5×UAS sequence at nucleotides 69-161, a T32 sequence (TALER32 protein target sequence) at nucleotides 177-190, a CMVmini promoter at nucleotides 197-256, a T32 sequence at nucleotides 263-276, and a mKate2 encoding gene at nucleotides 355-1073.

The pT35+T35+ plasmid is as shown in SEQ ID NO: 52. In the SEQ ID NO: 52, from the 5' end it comprises a 5×UAS sequence at nucleotides 69-161, a T35 sequence (TALER35 protein target sequence) at nucleotides 177-190, a CMVmini promoter at nucleotides 197-256, a T35 sequence at nucleotides 263-276, and a mKate2 encoding gene at nucleotides 355-1073.

I. Experiment 1

The pCMV-TALER1 plasmid, pT1+T1+ plasmid and pEF1a-TagBFP-2A plasmid were co-transfected into HEK293 cells (each well was transfected with 200 ng pCMV-TALER1 plasmid, 50 ng pT1+T1+ plasmid and 30 ng pEF1a-TagBFP-2A plasmid); after 48 hours of transfection, flow cytometry analysis was performed; and the fluorescence intensities of EYFP, mKate2 and TagBFP were detected. A control treatment without pCMV-TALER1 plasmid was set up. Repression fold=The correction value of mKate2 fluorescence intensity in control group÷the correction value of mKate2 fluorescence intensity in experimental group. Repression percentage=(The correction value of mKate2 fluorescence intensity in control group−the correction value of mKate2 fluorescence intensity in experimental group)÷the correction value of mKate2 fluorescence intensity in control group. The correction value of mKate2 fluorescence intensity=mKate2 fluorescence intensity/TagBFP fluorescence intensity.

The above procedure was carried out using the pCMV-TALER2 plasmid in place of the pCMV-TALER1 plasmid and the pT2+T2+ plasmid in place of the pT1+T1+ plasmid. The above procedure was carried out using the pCMV-TALER4 plasmid in place of the pCMV-TALER1 plasmid and the pT4+T4+ plasmid in place of the pT1+T1+ plasmid. The above procedure was carried out using the pCMV-TALER5 plasmid in place of the pCMV-TALER1 plasmid and the pT5+T5+ plasmid in place of the pT1+T1+ plasmid. The above procedure was carried out using the pCMV-TALER9 plasmid in place of the pCMV-TALER1 plasmid and the pT9+T9+ plasmid in place of the pT1+T1+ plasmid. The above procedure was carried out using the pCMV-TALER10 plasmid in place of the pCMV-TALER1 plasmid and the pT10+T10+ plasmid in place of the pT1+T1+ plasmid. The above procedure was carried out using the pCMV-TALER11 plasmid in place of the pCMV-TALER1 plasmid and the pT11+T11+ plasmid in place of the pT1+T1+ plasmid. The above procedure was carried out using the pCMV-TALER12 plasmid in place of the pCMV-TALER1 plasmid and the pT12+T12+ plasmid in place of the pT1+T1+ plasmid. The above procedure was carried out using the pCMV-TALER13 plasmid in place of the pCMV-TALER1 plasmid and the pT13+T13+ plasmid in place of the pT1+T1+ plasmid. The above procedure was carried out using the pCMV-TALER14 plasmid in place of the pCMV-TALER1 plasmid and the pT14+T14+ plasmid in place of the pT1+T1+ plasmid. The above procedure was carried out using the pCMV-TALER15 plasmid in place of the pCMV-TALER1 plasmid and the pT15+T15+ plasmid in place of the pT1+T1+ plasmid. The above procedure was carried out using the pCMV-TALER16 plasmid in place of the pCMV-TALER1 plasmid and the pT16+T16+ plasmid in place of the pT1+T1+ plasmid. The above procedure was carried out using the pCMV-TALER17 plasmid in place of the pCMV-TALER1 plasmid and the pT17+T17+ plasmid in place of the pT1+T1+ plasmid. The above procedure was carried out using the pCMV-TALER18 plasmid in place of the pCMV-TALER1 plasmid and the pT18+T18+ plasmid in place of the pT1+T1+ plasmid. The above procedure was carried out using the pCMV-TALER19 plasmid in place of the pCMV-TALER1 plasmid and the pT19+T19+ plasmid in place of the pT1+T1+ plasmid. The above procedure was carried out using the pCMV-TALER20 plasmid in place of the pCMV-TALER1 plasmid and the pT20+T20+ plasmid in place of the pT1+T1+ plasmid. The above procedure was carried out using the pCMV-TALER21 plasmid in place of the pCMV-TALER1 plasmid and the pT21+T21+ plasmid in place of the pT1+T1+ plasmid. The above procedure was carried out using the pCMV-TALER22 plasmid in place of the pCMV-TALER1 plasmid and the pT22+T22+ plasmid in place of the pT1+T1+ plasmid. The above procedure was carried out using the pCMV-TALER23 plasmid in place of the pCMV-TALER1 plasmid and the pT23+T23+ plasmid in place of the pT1+T1+ plasmid. The above procedure was carried out using the pCMV-TALER24 plasmid in place of the pCMV-TALER1 plasmid and the pT24+T24+ plasmid in place of the pT1+T1+ plasmid. The above procedure was carried out using the pCMV-TALER26 plasmid in place of the pCMV-TALER1 plasmid and the pT26+T26+ plasmid in place of the pT1+T1+ plasmid. The above procedure was carried out using the pCMV-TALER29 plasmid in place of the pCMV-TALER1 plasmid and the pT29+T29+ plasmid in place of the pT1+T1+ plasmid. The above procedure was carried out using the pCMV-TALER30 plasmid in place of the pCMV-TALER1 plasmid and the pT30+T30+ plasmid in place of the pT1+T1+ plasmid. The above procedure was carried out using the pCMV-TALER31 plasmid in place of the pCMV-TALER1 plasmid and the pT31+T31+ plasmid in place of the pT1+T1+ plasmid. The above procedure was carried out using the pCMV-TALER32 plasmid in place of the pCMV-TALER1 plasmid and the pT32+T32+ plasmid in place of the pT1+T1+ plasmid. The above procedure was carried out using the pCMV-TALER35 plasmid in place of the pCMV-TALER1 plasmid and the pT35+T35+ plasmid in place of the pT1+T1+ plasmid.

Figure 3:
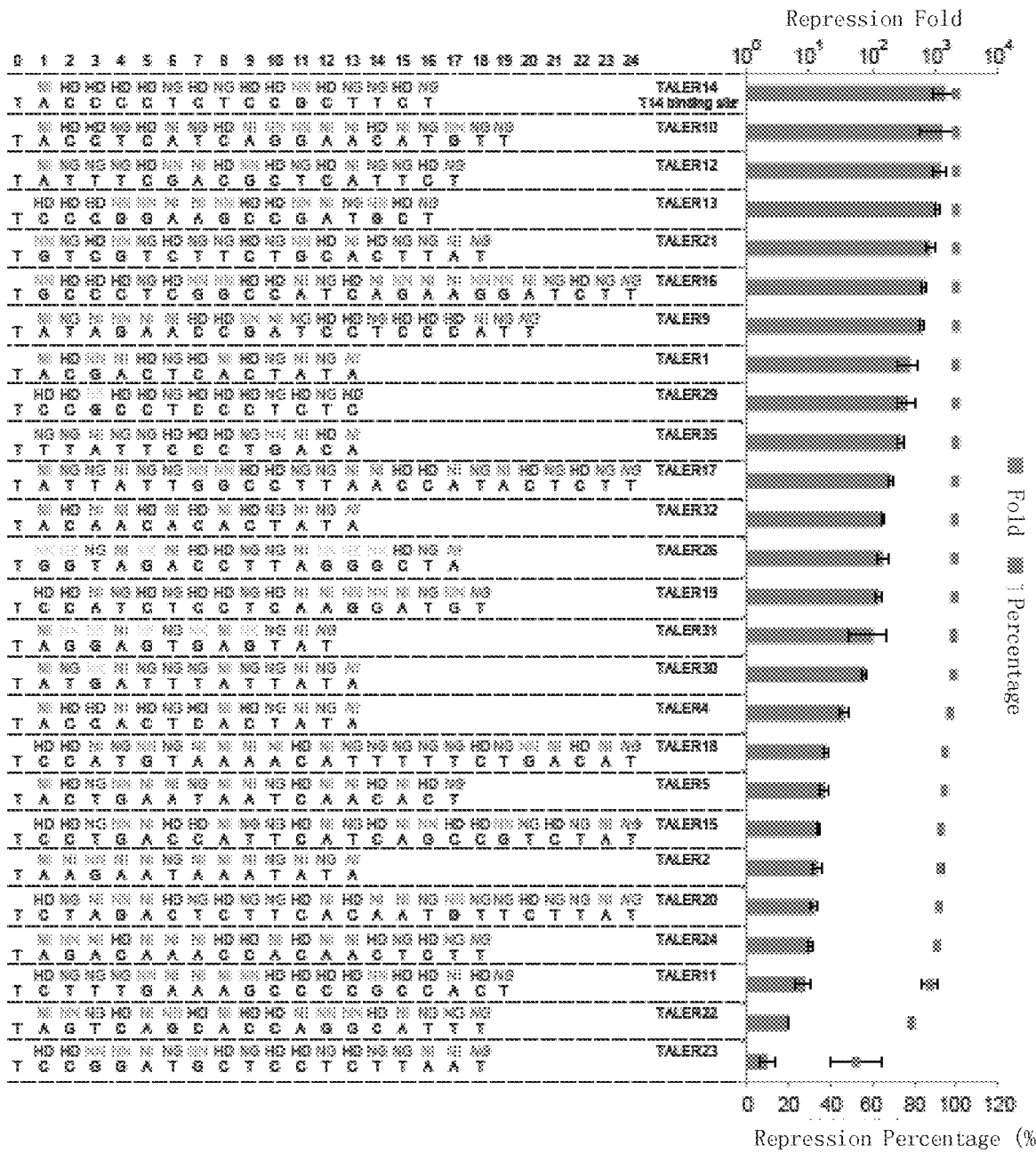
FIG. 3 is the result of step one in Example 1. TALER14 binding site, SEQ ID NO: 135; TALER10 binding site, SEQ ID NO: 136; TALER12 binding site, SEQ ID NO: 137; TALER13 binding site, SEQ ID NO: 138; TALER21 binding site, SEQ ID NO: 139; TALER16 binding site, SEQ ID NO: 140; TALER9 binding site, SEQ ID NO: 141; TALER1 binding site, SEQ ID NO: 142; TALER29 binding site, SEQ ID NO: 143; TALER35 binding site, SEQ ID NO: 144; TALER17 binding site, SEQ ID NO: 145; TALER32 binding site, SEQ ID NO: 146; TALER26 binding site, SEQ ID NO: 147; TALER19 binding site, SEQ ID NO: 148; TALER31 binding site, SEQ ID NO: 149; TALER30 binding site, SEQ ID NO: 150; TALER4 binding site, SEQ ID NO: 151; TALER18 binding site, SEQ ID NO: 152; TALER5 binding site, SEQ ID NO: 153; TALER15 binding site, SEQ ID NO: 154; TALER2 binding site, SEQ ID NO: 155; TALER20 binding site, SEQ ID NO: 156; TALER24 binding site, SEQ ID NO: 157; TALER11 binding site, SEQ ID NO: 158; TALER22 binding site, SEQ ID NO: 159; TALER23 binding site, SEQ ID NO: 160.

See FIG. 3 (bar graph represents repression fold, scatter plot represents repression percentage) and Table 1 for the results of repression factor and repression percentage. 23 of the 26 TALER proteins exhibited transcriptional repression effect greater than 90%, among which 16 TALER proteins had a transcriptional repression effect greater than 100-fold. The results demonstrated that the TALER proteins (the TALEN fusion proteins without repression domains) can also exert efficient transcriptional repression through steric hindrance in mammalian cells.

TABLE 1

The Results of Repression Fold and Repression Percentage

| Plasmids in the reaction system | | | Repression fold | Repression percentage |
|---|---|---|---|---|
| pCMV-TALER1 plasmid | pT1 + T1 + plasmid | pEF1a-TagBFP-2A | 396.97 | 99.73% |
| pCMV-TALER2 plasmid | pT2 + T2 + plasmid | pEF1a-TagBFP-2A | 13.50 | 92.46% |
| pCMV-TALER4 plasmid | pT4 + T4 + plasmid | pEF1a-TagBFP-2A | 36.04 | 97.19% |
| pCMV-TALER5 plasmid | pT5 + T5 + plasmid | pEF1a-TagBFP-2A | 17.89 | 94.30% |
| pCMV-TALER9 plasmid | pT9 + T9 + plasmid | pEF1a-TagBFP-2A | 636.15 | 99.84% |
| pCMV-TALER10 plasmid | pT10 + T10 + plasmid | pEF1a-TagBFP-2A | 1310.15 | 99.90% |
| pCMV-TALER11 plasmid | pT11 + T11 + plasmid | pEF1a-TagBFP-2A | 8.48 | 87.46% |

TABLE 1-continued

The Results of Repression Fold and Repression Percentage

| Plasmids in the reaction system | | | Repression fold | Repression percentage |
|---|---|---|---|---|
| pCMV-TALER12 plasmid | pT12 + T12 + plasmid | pEF1a-TagBFP-2A | 1216.68 | 99.92% |
| pCMV-TALER13 plasmid | pT13 + T13 + plasmid | pEF1a-TagBFP-2A | 1079.09 | 99.91% |
| pCMV-TALER14 plasmid | pT14 + T14 + plasmid | pEF1a-TagBFP-2A | 1439.87 | 99.93% |
| pCMV-TALER15 plasmid | pT15 + T15 + plasmid | pEF1a-TagBFP-2A | 13.74 | 92.71% |
| pCMV-TALER16 plasmid | pT16 + T16 + plasmid | pEF1a-TagBFP-2A | 674.76 | 99.85% |
| pCMV-TALER17 plasmid | pT17 + T17 + plasmid | pEF1a-TagBFP-2A | 195.15 | 99.49% |
| pCMV-TALER18 plasmid | pT18 + T18 + plasmid | pEF1a-TagBFP-2A | 18.53 | 94.58% |
| pCMV-TALER19 plasmid | pT19 + T19 + plasmid | pEF1a-TagBFP-2A | 129.32 | 99.22% |
| pCMV-TALER20 plasmid | pT20 + T20 + plasmid | pEF1a-TagBFP-2A | 12.34 | 91.80% |
| pCMV-TALER21 plasmid | pT21 + T21 + plasmid | pEF1a-TagBFP-2A | 846.43 | 99.88% |
| pCMV-TALER22 plasmid | pT22 + T22 + plasmid | pEF1a-TagBFP-2A | 4.66 | 78.52% |
| pCMV-TALER23 plasmid | pT23 + T23 + plasmid | pEF1a-TagBFP-2A | 2.20 | 52.30% |
| pCMV-TALER24 plasmid | pT24 + T24 + plasmid | pEF1a-TagBFP-2A | 10.89 | 90.78% |
| pCMV-TALER26 plasmid | pT26 + T26 + plasmid | pEF1a-TagBFP-2A | 147.77 | 99.31% |
| pCMV-TALER29 plasmid | pT29 + T29 + plasmid | pEF1a-TagBFP-2A | 361.65 | 99.71% |
| pCMV-TALER30 plasmid | pT30 + T30 + plasmid | pEF1a-TagBFP-2A | 77.01 | 98.70% |
| pCMV-TALER31 plasmid | pT31 + T31 + plasmid | pEF1a-TagBFP-2A | 102.67 | 98.80% |
| pCMV-TALER32 plasmid | pT32 + T32 + plasmid | pEF1a-TagBFP-2A | 148.17 | 99.32% |
| pCMV-TALER35 plasmid | pT35 + T35 + plasmid | pEF1a-TagBFP-2A | 289.26 | 99.65% |

II. Experiment 2

On the basis of experiment 1, the orthogonality was detected by determining the effect of transcriptional repression of the top 10 TALER proteins with the strongest inhibitory effect on the verification module (Tx-CMVmini promoter-Tx-mKate2 gene).

Take an example as follows: The pCMV-TALER1 plasmid, pT35+T35+ plasmid and pEF1a-TagBFP-2A plasmid were co-transfected into HEK293 cells (each well was transfected with 200 ng pCMV-TALER1 plasmid, 50 ng pT1+T1+ plasmid and 30 ng pEF1a-TagBFP-2A plasmid); after 48 hours of transfection, flow cytometry analysis was performed; and the fluorescence intensities of EYFP, mKate2 and TagBFP were detected. A control treatment without pCMV-TALER1 plasmid was set up.

Figure 4:
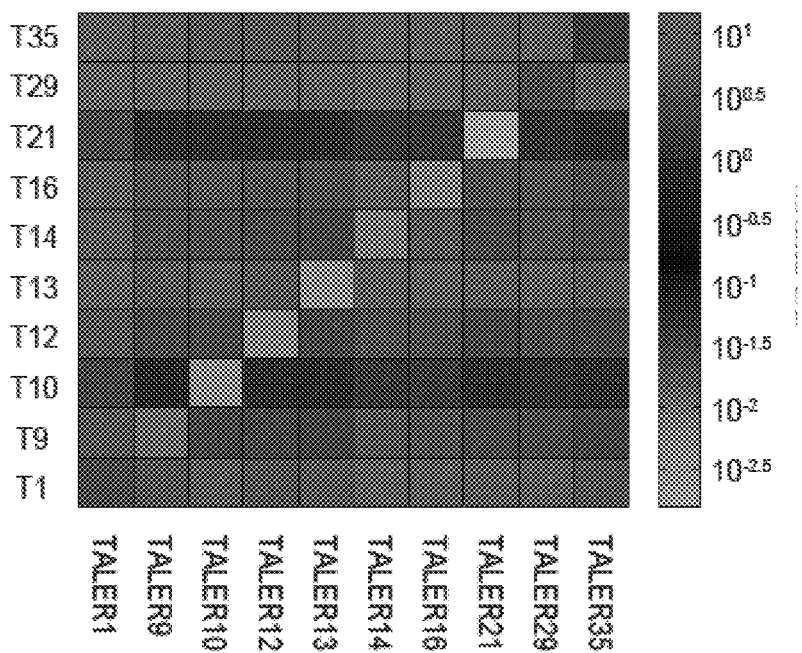
FIG. 4 is the result of step two in Example 2.

See FIG. 4 ($10^1$ to $10^{-2.5}$ in FIG. 4 represent mKate2 fluorescence intensity/TagBFP fluorescence intensity) and Table 2 for results. All TALER proteins tested exhibited strong inhibitory effects on the promoters between their corresponding targets but had little effect on the promoters between other targets. For example, TALER1, TALER9, TALER10, TALER12, TALER14, and TALER21 proteins had more than 100-fold repression fold on the promoters between their corresponding targets than the promoters between other targets.

TABLE 2

The Results of FIG. 4 (mKate2 Fluorescence Intensity/TagBFP Fluorescence Intensity)

| TALER plasmids | Target plasmids | | | | | | | | | |
|---|---|---|---|---|---|---|---|---|---|---|
| | pT1+ T1+ | pT9+ T9+ | pT10+ T10+ | pT12+ T12+ | pT13+ T13+ | pT14+ T14+ | pT16+ T16+ | pT21+ T21+ | pT29+ T29+ | pT35+ T35+ |
| pCMV-TALER35 | 9.62 | 5.57 | 5.30 | 5.09 | 4.80 | 8.63 | 8.33 | 6.19 | 6.90 | 0.04 |
| pCMV-TALER29 | 14.72 | 10.20 | 10.75 | 9.85 | 9.58 | 13.08 | 9.83 | 8.75 | 0.03 | 7.35 |
| pCMV-TALER21 | 2.67 | 1.09 | 1.07 | 1.02 | 1.01 | 1.50 | 1.38 | 0.00 | 1.27 | 0.94 |
| pCMV-TALER16 | 6.63 | 3.78 | 4.52 | 3.63 | 3.36 | 5.79 | 0.01 | 3.98 | 3.71 | 3.01 |
| pCMV-TALER14 | 7.23 | 3.12 | 3.22 | 3.02 | 2.62 | 0.01 | 4.71 | 2.82 | 3.54 | 2.73 |
| pCMV-TALER13 | 10.97 | 4.87 | 5.48 | 5.07 | 0.00 | 8.01 | 7.45 | 6.04 | 7.25 | 5.18 |
| pCMV-TALER12 | 5.31 | 3.04 | 2.93 | 0.01 | 2.51 | 3.85 | 3.53 | 2.61 | 3.03 | 2.52 |
| pCMV-TALER10 | 2.51 | 0.84 | 0.00 | 1.04 | 0.93 | 1.46 | 1.66 | 1.06 | 1.19 | 1.03 |

TABLE 2-continued

The Results of FIG. 4 (mKate2 Fluorescence Intensity/TagBFP Fluorescence Intensity)

| TALER plasmids | Target plasmids | | | | | | | | | |
|---|---|---|---|---|---|---|---|---|---|---|
| | pT1+ T1+ | pT9+ T9+ | pT10+ T10+ | pT12+ T12+ | pT13+ T13+ | pT14+ T14+ | pT16+ T16+ | pT21+ T21+ | pT29+ T29+ | pT35+ T35+ |
| pCMV-TALER9 | 5.14 | 0.01 | 2.54 | 2.38 | 2.17 | 4.42 | 3.97 | 2.95 | 2.94 | 2.15 |
| pCMV-TALER1 | 0.03 | 4.48 | 5.50 | 4.64 | 4.84 | 8.52 | 7.52 | 6.20 | 6.69 | 4.40 |

Example 2. Further Extension Research pEF1a-TagBFP-2A plasmid is the pEF1a-TagBFP-2A plasmid in Example 1.

pCMV-TALER1 plasmid is the pCMV-TALER1 plasmid in Example 1.

pCMV-TALER2 plasmid is the pCMV-TALER2 plasmid in Example 1.

pCMV-TALER4 plasmid is the pCMV-TALER4 plasmid in Example 1.

pCMV-TALER5 plasmid is the pCMV-TALER5 plasmid in Example 1.

pCMV-TALER32 plasmid is the pCMV-TALER32 plasmid in Example 1.

The pT1+T1+72-DsRed plasmid is as shown in SEQ ID NO: 54. In the SEQ ID NO: 54, from the 5' end it comprises a 5×UAS sequence at nucleotides 2441-2533, a T1 sequence (TALER1 protein target sequence) at nucleotides 2549-2562, a CMVmini promoter at nucleotides 2569-2628, a T1 sequence at nucleotides 2635-2648, and a DsRed (red fluorescent protein) encoding gene at nucleotides 2668-3345.

The pT1+T2+72-DsRed plasmid is as shown in SEQ ID NO: 55. In the SEQ ID NO: 55, from the 5' end it comprises a 5×UAS sequence at nucleotides 2441-2533, a T1 sequence at nucleotides 2549-2562, a CMVmini promoter at nucleotides 2569-2628, a T2 sequence (TALER2 protein target sequence) at nucleotides 2635-2648, and a DsRed encoding gene at nucleotides 2668-3345.

The pT2+T1+72-DsRed plasmid is as shown in SEQ ID NO: 56. In the SEQ ID NO: 56, from the 5' end it comprises a 5×UAS sequence at nucleotides 2441-2533, a T2 sequence at nucleotides 2549-2562, a CMVmini promoter at nucleotides 2569-2628, a T1 sequence at nucleotides 2635-2648, and a DsRed encoding gene at nucleotides 2668-3345.

The pT2+T2+72-DsRed plasmid is as shown in SEQ ID NO: 57. In the SEQ ID NO: 57, from the 5' end it comprises a 5×UAS sequence at nucleotides 2441-2533, a T2 sequence at nucleotides 2549-2562, a CMVmini promoter at nucleotides 2569-2628, a T2 sequence at nucleotides 2635-2648, and a DsRed encoding gene at nucleotides 2668-3345.

The pT1+T1+72-mKate2 plasmid is as shown in SEQ ID NO: 58. In the SEQ ID NO: 58, from the 5' end it comprises a 5×UAS sequence at nucleotides 4275-4367, a T1 sequence at nucleotides 4383-4396, a CMVmini promoter at nucleotides 4403-4462, a T1 sequence at nucleotides 4469-4482, and a mKate2 encoding gene at nucleotides 4532-5237.

The pT1+T1+78-mKate2 plasmid is as shown in SEQ ID NO: 59. In the SEQ ID NO: 59, from the 5' end it comprises a 5×UAS sequence at nucleotides 7161-7253, a T1 sequence at nucleotides 7269-7282, a CMVmini promoter at nucleotides 6-65, a T1 sequence at nucleotides 78-91, and a mKate2 encoding gene at nucleotides 170-888.

The pT1+T1+83-mKate2 plasmid is as shown in SEQ ID NO: 60. In the SEQ ID NO: 60, from the 5' end it comprises a 5×UAS sequence at nucleotides 7166-7258, a T1 sequence at nucleotides 7274-7287, a CMVmini promoter at nucleotides 6-65, a T1 sequence at nucleotides 83-96, and a mKate2 encoding gene at nucleotides 175-893.

The pT1+T1+89-mKate2 plasmid is as shown in SEQ ID NO: 61. In the SEQ ID NO: 61, from the 5' end it comprises a 5×UAS sequence at nucleotides 7172-7264, a T1 sequence at nucleotides 7280-7293, a CMVmini promoter at nucleotides 6-65, a T1 sequence at nucleotides 89-102, and a mKate2 encoding gene at nucleotides 181-899.

The pT1+T1+94-mKate2 plasmid is as shown in SEQ ID NO: 62. In the SEQ ID NO: 62, from the 5' end it comprises a 5×UAS sequence at nucleotides 7177-7269, a T1 sequence at nucleotides 7285-7298, a CMVmini promoter at nucleotides 6-65, a T1 sequence at nucleotides 94-107, and a mKate2 encoding gene at nucleotides 186-904.

The pT1+T1+100-mKate2 plasmid is as shown in SEQ ID NO: 63. In the SEQ ID NO: 63, from the 5' end it comprises a 5×UAS sequence at nucleotides 7203-7295, a T1 sequence at nucleotides 6-19, a CMVmini promoter at nucleotides 26-85, a T1 sequence at nucleotides 120-133, and a mKate2 encoding gene at nucleotides 212-930.

The pT2+T2+72-mKate2 plasmid is as shown in SEQ ID NO: 64. In the SEQ ID NO: 64, from the 5' end it comprises a 5×UAS sequence at nucleotides 69-161, a T2 sequence at nucleotides 177-190, a CMVmini promoter at nucleotides 197-256, a T2 sequence at nucleotides 263-276, and a mKate2 encoding gene at nucleotides 355-1073.

The pT2+T2x3+72-mKate2 plasmid is as shown in SEQ ID NO: 65. In the SEQ ID NO: 65, from the 5' end it comprises a 5×UAS sequence at nucleotides 69-161, a T2 sequence at nucleotides 177-190, a CMVmini promoter at nucleotides 197-256, a T2 sequence at nucleotides 263-276, a T2 sequence at nucleotides 279-292, a T2 sequence at nucleotides 295-308, and a mKate2 encoding gene at nucleotides 388-1106.

The pT4+T4+72-mKate2 plasmid is as shown in SEQ ID NO: 66. In the SEQ ID NO: 66, from the 5' end it comprises a 5×UAS sequence at nucleotides 69-161, a T4 sequence (TALER4 protein target sequence) at nucleotides 177-190, a CMVmini promoter at nucleotides 197-256, a T4 sequence at nucleotides 263-276, and a mKate2 encoding gene at nucleotides 355-1073.

The pT4+T4x3+72-mKate2 plasmid is as shown in SEQ ID NO: 67. In the SEQ ID NO: 67, from the 5' end it comprises a 5×UAS sequence at nucleotides 69-161, a T4 sequence at nucleotides 177-190, a CMVmini promoter at nucleotides 197-256, a T4 sequence at nucleotides 263-276, a T4 sequence at nucleotides 277-290, a T4 sequence at nucleotides 291-304, and a mKate2 encoding gene at nucleotides 383-1101.

The pT5+T5+72-mKate2 plasmid is as shown in SEQ ID NO: 68. In the SEQ ID NO: 68, from the 5' end it comprises a 5×UAS sequence at nucleotides 69-161, a T5 sequence (TALER5 protein target sequence) at nucleotides 177-194, a CMVmini promoter at nucleotides 201-260, a T5 sequence at nucleotides 267-284, and a mKate2 encoding gene at nucleotides 363-1081.

The pT5+T5x3+72-mKate2 plasmid is as shown in SEQ ID NO: 69. In the SEQ ID NO: 69, from the 5' end it comprises a 5×UAS sequence at nucleotides 69-161, a T5 sequence at nucleotides 177-194, a CMVmini promoter at nucleotides 201-260, a T5 sequence at nucleotides 267-284, a T5 sequence at nucleotides 285-302, a T5 sequence at nucleotides 303-320, and a mKate2 encoding gene at nucleotides 399-1117.

The pT32+T32+72-mKate2 plasmid is as shown in SEQ ID NO: 70. In the SEQ ID NO: 70, from the 5' end it comprises a 5×UAS sequence at nucleotides 69-161, a T32 sequence (TALER32 protein target sequence) at nucleotides 177-190, a CMVmini promoter at nucleotides 197-256, a T32 sequence at nucleotides 263-276, and a mKate2 encoding gene at nucleotides 355-1073.

The pT32+T32x3+72-mKate2 is as shown in SEQ ID NO: 71. In the SEQ ID NO: 71, from the 5' end it comprises a 5×UAS sequence at nucleotides 69-161, a T32 sequence at nucleotides 177-190, a CMVmini promoter at nucleotides 197-256, a T32 sequence at nucleotides 263-276, a T32 sequence at nucleotides 277-290, a T32 sequence at nucleotides 291-304, and a mKate2 encoding gene at nucleotides 383-1101.

I. Experiment 1

The pCMV-TALER1 plasmid, pT1+T1+72-DsRed plasmid and pEF1a-TagBFP-2A plasmid were co-transfected into HEK293 cells (each well was transfected with 200 ng pCMV-TALER1 plasmid, 50 ng pT1+T1+72-DsRed plasmid and 30 ng pEF1a-TagBFP-2A plasmid); after 48 hours of transfection, flow cytometry analysis was performed; and the fluorescence intensities of EYFP, DsRed and TagBFP were detected. A control treatment without pCMV-TALER1 plasmid was set up.

The above procedure was carried out using pT1+T2+72-DsRed plasmid, pT2+T1+72-DsRed plasmid or pT2+T2+72-DsRed plasmid in place of the pT1+T1+72-DsRed plasmid.

Figure 5:
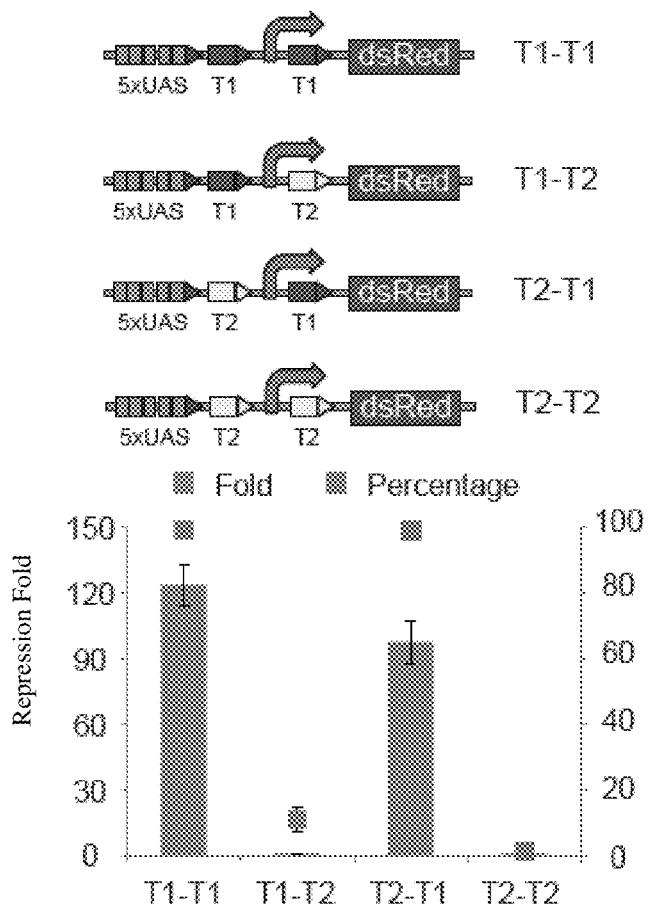
FIG. 5 is the result of step one in Example 2.

See FIG. 5 and Table 3 for the results of repression fold and repression percentage. The results demonstrated that the 3' binding site of TALER protein is required for strong inhibition ability, but the 5' binding site has much weak inhibitory effect. The inhibitory effect is even stronger when both the 3' and 5' binding sites exist.

TABLE 3

The Results of Repression Fold and Repression Percentage

| Plasmids in the reaction system | | | Repression fold | Repression percentage |
|---|---|---|---|---|
| pCMV-TALER1 plasmid | pT1 + T1 + 72-DsRed plasmid | pEF1a-TagBFP-2A | 123.73 | 99.19% |
| pCMV-TALER1 plasmid | pT1 + T2 + 72-DsRed plasmid | pEF1a-TagBFP-2A | 1.13 | 11.23% |
| pCMV-TALER1 plasmid | pT2 + T1 + 72-DsRed plasmid | pEF1a-TagBFP-2A | 97.44 | 98.96% |
| pCMV-TALER1 plasmid | pT2 + T2 + 72-DsRed plasmid | pEF1a-TagBFP-2A | 1.02 | 1.50% |

II. Experiment 2

The pCMV-TALER1 plasmid, pT1+T1+72-mKate2 plasmid and pEF1a-TagBFP-2A plasmid were co-transfected into HEK293 cells (each well was transfected with 200 ng pCMV-TALER1 plasmid, 50 ng pT1+T1+72-mKate2 plasmid and 30 ng pEF1a-TagBFP-2A plasmid); after 48 hours of transfection, flow cytometry analysis was performed; and the fluorescence intensity of EYFP, mKate2 and TagBFP were detected. A control treatment without pCMV-TALER1 plasmid was set up.

The above procedure was carried out using pT1+T1+78-mKate2 plasmid, pT1+T1+83-mKate2 plasmid, pT1+T1+89-mKate2 plasmid, pT1+T1+94-mKate2 plasmid or pT1+T1+100-mKate2 plasmid in place of the pT1+T1+72-mKate2 plasmid.

Figure 6:
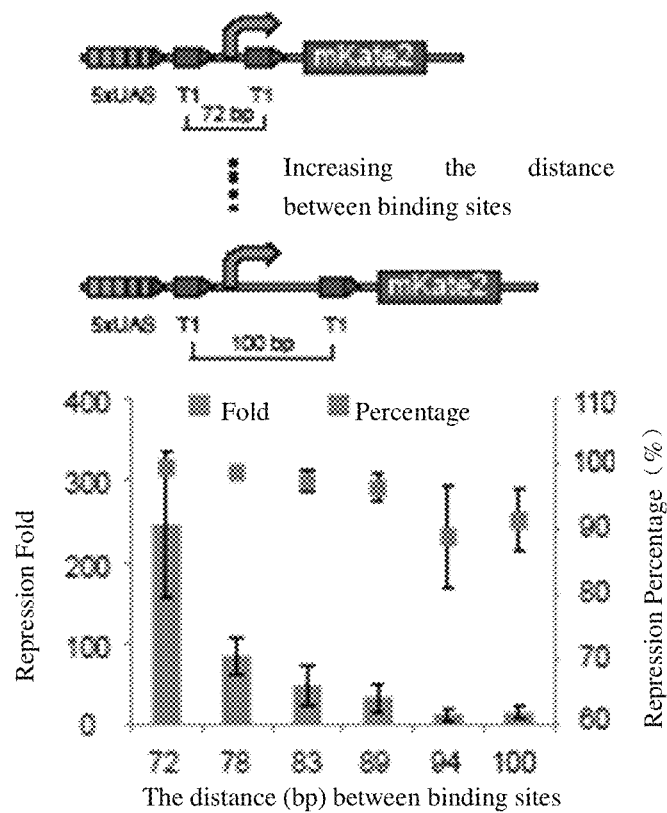
FIG. 6 is the result of step two in Example 2.

See FIG. 6 and Table 4 for the results of repression fold and repression percentage. The TALER proteins do not have periodic inhibitory behaviour, and have stronger inhibitory effect as the TALER binding sites are closer to the miniCMV promoter.

TABLE 4

The Results of Repression Fold and Repression Percentage

| Plasmids in the reaction system | | | Repression fold | Repression percentage |
|---|---|---|---|---|
| pCMV-TALER1 plasmid | pT1 + T1 + 72-mKate2 plasmid | pEF1a-TagBFP-2A | 245.60 | 99.54% |

TABLE 4-continued

The Results of Repression Fold and Repression Percentage

| Plasmids in the reaction system | | | Repression fold | Repression percentage |
|---|---|---|---|---|
| pCMV-TALER1 plasmid | pT1 + T1 + 78-mKate2 plasmid | pEF1a-TagBFP-2A | 84.56 | 98.74% |
| pCMV-TALER1 plasmid | pT1 + T1 + 83-mKate2 plasmid | pEF1a-TagBFP-2A | 47.42 | 97.30% |
| pCMV-TALER1 plasmid | pT1 + T1 + 89-mKate2 plasmid | pEF1a-TagBFP-2A | 33.34 | 96.36% |
| pCMV-TALER1 plasmid | pT1 + T1 + 94-mKate2 plasmid | pEF1a-TagBFP-2A | 12.26 | 88.81% |
| pCMV-TALER1 plasmid | pT1 + T1 + 100-mKate2 plasmid | phEF1a-TagBFP-2A | 14.34 | 91.38% |

III. Experiment 3

The pCMV-TALER2 plasmid, pT2+T2+72-mKate2 plasmid (or T2+T2x3+72-mKate2 plasmid) and pEF1a-TagBFP-2A plasmid were co-transfected into HEK293 cells (each well was transfected with 200 ng pCMV-TALER2 plasmid, 50 ng pT2+T2+72-mKate2 plasmid or T2+T2x3+72-mKate2 plasmid and 30 ng pEF1a-TagBFP-2A plasmid); after 48 hours of transfection, flow cytometry analysis was performed; and the fluorescence intensities of EYFP, mKate2 and TagBFP were detected. A control treatment without pCMV-TALER2 plasmid was set up.

The above procedure was carried out using pCMV-TALER4 plasmid in place of the pCMV-TALER2 plasmid, pT4+T4+72-mKate2 plasmid in place of the pT2+T2+72-mKate2 plasmid (or using the pT4+T4x3+72-mKate2 plasmid in place of the T2+T2x3+72-mKate2 plasmid).

The above procedure was carried out using pCMV-TALER5 plasmid in place of the pCMV-TALER2 plasmid, pT5+T5+72-mKate2 plasmid in place of the pT2+T2+72-mKate2 plasmid (or using the pT5+T5x3+72-mKate2 plasmid in place of the T2+T2x3+72-mKate2 plasmid).

The above procedure was carried out using pCMV-TALER32 plasmid in place of the pCMV-TALER2 plasmid, pT32+T32+72-mKate2 plasmid in place of the pT2+T2+72-mKate2 plasmid (or using the pT32+T32x3+72-mKate2 plasmid in place of the T2+T2x3+72-mKate2 plasmid).

Figure 7:
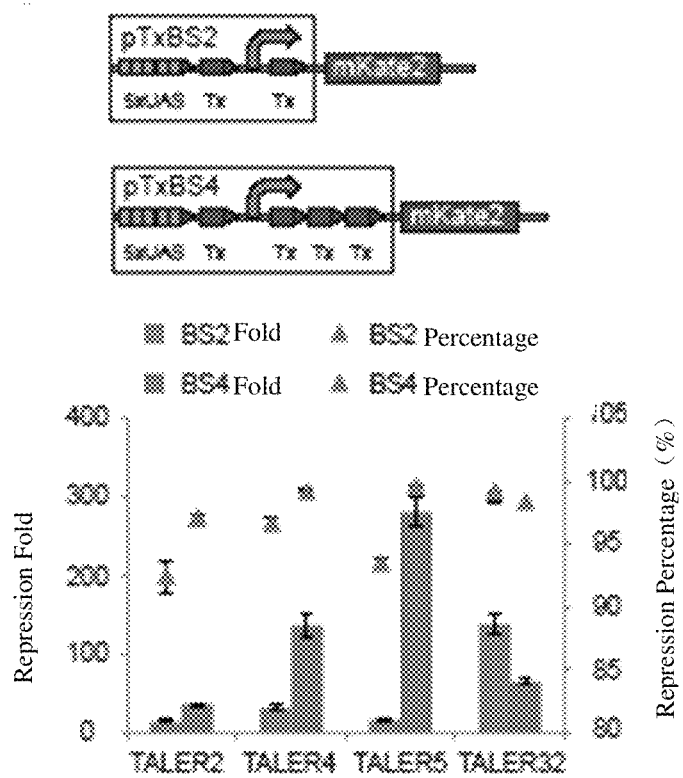
FIG. 7 is the result of step three in Example 2.

See FIG. 7 and Table 5 for the results of repression fold and repression percentage. The TALER proteins exhibited stronger inhibitory effects when the downstream of the miniCMV promoter had three targets as compared with only one targets at the downstream of the miniCMV promoter. In some highly efficient TALERs, additional binding sites unexpectedly resulted in a slight attenuation of inhibitory effects. The inventors had noted that the TALER proteins with high inhibition ability was significantly reduced by the additional inhibition ability resulted from additional binding sites, but the background expression of promoters can also be reduced by the inserted sequence between the miniCMV promoter and the reporter gene. These results indicated that the transcriptional inhibition ability can be optimized by balancing the background expression level of promoters and the ability of TALERs to inhibit the miniCMV promoter.

TABLE 5

The Results of Repression Fold and Repression Percentage

| Plasmids in the reaction system | | | Repression fold | Repression percentage |
|---|---|---|---|---|
| pCMV-TALER2 plasmid | pT2 + T2 + 72-mKate2 plasmid | pEF1a-TagBFP-2A | 13.50 | 92.46% |
| | T2 + T2 × 3 + 72-mKate2 plasmid | pEF1a-TagBFP-2A | 34.97 | 97.13% |
| pCMV-TALER4 plasmid | pT4 + T4 + 72-mKate2 plasmid | pEF1a-TagBFP-2A | 30.74 | 96.71% |
| | pT4 + T4 ×3 + 72-mKate2 plasmid | pEF1a-TagBFP-2A | 135.72 | 99.26% |
| pCMV-TALER5 plasmid | pT5 + T5 + 72-mKate2 plasmid | pEF1a-TagBFP-2A | 15.43 | 93.51% |
| | pT5 + T5 ×3 + 72-mKate2 plasmid | pEF1a-TagBFP-2A | 281.03 | 99.64% |
| pCMV-TALER32 plasmid | pT32 + T32 + 72-mKate2 plasmid | pEF1a-TagBFP-2A | 138.11 | 99.27% |
| | pT32 + T32 ×3 + 72-mKate2 plasmid | pEF1a-TagBFP-2A | 64.07 | 98.44% |

IV. Experiment 4

Synthesis of the plasmid shown in SEQ ID NO: 72 of the sequence list. In the SEQ ID NO: 72, from the 5' end it comprises a doxycycline responsive element TRE at nucleotides 4766-5033 (wherein a tetO is at nucleotides 4766-4961 and a CMVmini promoter is at nucleotides 4976-5033), a TALER14 protein encoding gene at nucleotides 5113-8250, a cHS4 core at nucleotides 9306-9549, a cHS4 core at nucleotides 9625-9868, a 5×UAS sequence at nucleotides 9987-10079, a T14 sequence (TALER14 protein target sequence) at nucleotides 10095-10111, a CMVmini promoter at nucleotides 10118-10177, a T14 sequence at nucleotides 10184-10200, a T14 sequence at nucleotides 10201-10217, a T14 sequence at nucleotides 10218-10234, a mKate2 encoding gene at nucleotides 10313-11031, a cHS4 core at nucleotides 11979-12222, a cHS4 core at nucleotides 12298-12541, a doxycycline responsive element TRE at nucleotides 12658-12925 (wherein a tetO is at nucleotides 112658-12853 and a CMVmini promoter is at nucleotides 12868-12925), a EYFP encoding gene at nucleotides 12982-13701, a cHS4 core at nucleotides 14612-14855, a cHS4 core at nucleotides 14931-15174, a pEF1a (promoter) at nucleotides 15292-16465, a Gal4/vp16 encoding gene at nucleotides 16539-17219, a 2A linking peptide encoding gene at nucleotides 17220-17285, and a rtTA encoding gene at nucleotides 17292-17996. See FIG. 8A for the schematic diagram of plasmid elements shown in the SEQ ID NO: 72.

The plasmid shown in SEQ ID NO: 72 was introduced into HEK293 cells to obtain recombinant cells. In the absence of doxycycline (DOX), Gal4/vp16 and rtTA were expressed under the effect of pEF1a; Gal4/vp16 binding to the 5×UAS sequence activated the transcriptional initiation of the CMVmini promoter and mKate2 was expressed. After the addition of doxycycline, doxycycline bound to rtTA to activate the doxycycline response element TRE, then TALER14 protein and EYFP were expressed; the TALER14 protein binding to T14 sequence played a role of a transcriptional repression by steric hindrance, and the CMVmini promoter between two T14 sequences was inactivated and thereby the expression of mKate2 was inhibited. The expression of TALER14 under the induction of Dox was estimated by the expression level of EYFP, while the expression level variation of mKate2 reflected the inhibitory effect of TALER14 on the CMVmini promoter between two T14 sequences.

Figure 8:
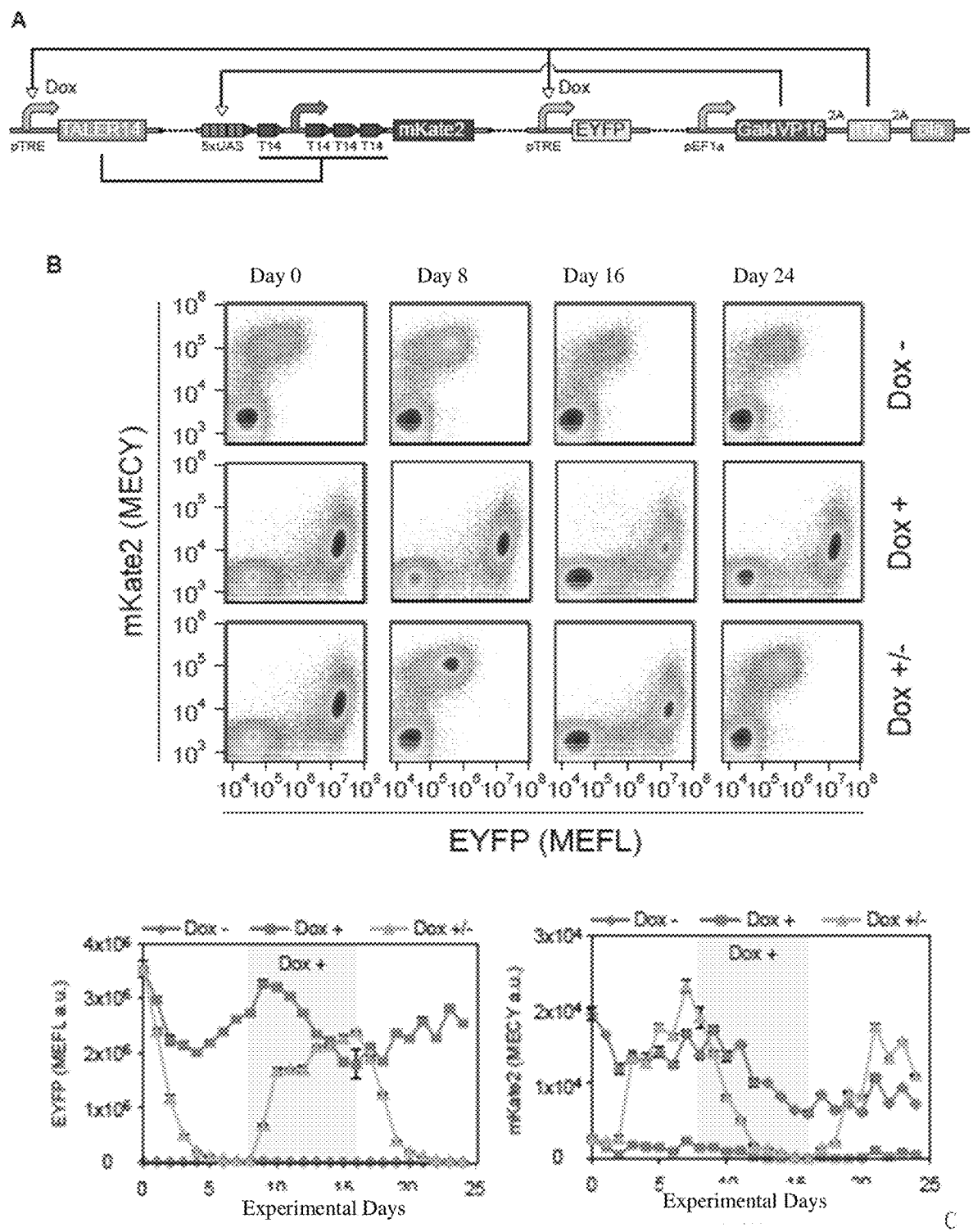
FIG. 8 is the result of step four in Example 2.

The recombinant cells were cultured in Dox-containing environment until the expression of mKate2 was maximally inhibited, followed by replacement with Dox-free medium. After 3 days from Dox removal, the expression level of EYFP decreased to 16% of the maximal value, whereas the expression level of mKate2 almost restored to the level of the control group without Dox induction. Then, induction by adding Dox on day 8 rendered the expression level of mKate2 to be inhibited again. The expression level of mKate2 could still be restored by replacing with Dox-free medium on day 16. The specific results are shown in FIGS. 8B and 8C. The above results indicated that the TALER proteins can achieve fast and reversible transcriptional inhibition function.

Example 3. Modular Construction of TALER Protein Cascade Gene Circuits

The pCAG-rtTA-2A-Gal4/vp16 plasmid is as shown in SEQ ID NO: 73. In the SEQ ID NO: 73, from the 5' end it comprises a CAG promoter at nucleotides 4253-4930, a rtTA encoding gene at nucleotides 6004-6747, a 2A linking peptide encoding gene at nucleotides 6748-6813, a Gal4/vp16 encoding gene at nucleotides 6820-7503.

The pT14+T14+72-mKate2 plasmid is as shown in SEQ ID NO: 74. In the SEQ ID NO: 74, from the 5' end it comprises a 5×UAS sequence at nucleotides 4275-4367, a T14 sequence (TALER14 protein target sequence) at nucleotides 4383-4399, a CMVmini promoter at nucleotides 4406-4465, a T14 sequence at nucleotides 4472-4488, and a mKate2 encoding gene at nucleotides 4538-5243. The pT14+T14+72-mKate2 plasmid has two TALER14 protein binding sites (pT14BS2).

The pT14+T14x3+72-mKate2 plasmid is as shown in SEQ ID NO: 75. In the SEQ ID NO: 75, from the 5' end it comprises a 5×UAS sequence at nucleotides 69-161, a T14 sequence at nucleotides 177-193, a CMVmini promoter at nucleotides 200-259, a T14 sequence at nucleotides 266-282, a T14 sequence at nucleotides 283-299, a T14 sequence at nucleotides 300-316, and a mKate2 encoding gene at nucleotides 395-1113. The pT14+T14x3+72-mKate2 plasmid has four TALER14 protein binding sites (pT14BS4).

The pT21+T21+72-mKate2 plasmid is as shown in SEQ ID NO: 76. In the SEQ ID NO: 76, from the 5' end it comprises a 5×UAS sequence at nucleotides 4275-4367, a T21 sequence (TALER21 protein target sequence) at nucleotides 4383-4401, a CMVmini promoter at nucleotides 4408-4467, a T21 sequence at nucleotides 4474-4492, and a mKate2 encoding gene at nucleotides 4542-5247. The pT21+T21+72-mKate2 plasmid has two TALER21 protein binding sites (pT21BS2).

The pT21+T21x3+72-mKate2 plasmid is as shown in SEQ ID NO: 77. In the SEQ ID NO: 77, from the 5' end it comprises a 5×UAS sequence at nucleotides 69-161, a T21 sequence at nucleotides 177-195, a CMVmini promoter at nucleotides 202-261, a T21 sequence at nucleotides 268-286, a T21 sequence at nucleotides 287-305, a T21 sequence at nucleotides 306-324, and a mKate2 encoding gene at nucleotides 403-1121. The pT21+T21x3+72-mKate2 plasmid has four TALER21 protein binding sites (pT21BS4).

The pTRE-EBFP2 plasmid is as shown in SEQ ID NO: 78. In the SEQ ID NO: 78, from the 5' end it comprises a doxycycline responsive element TRE at nucleotides 4250-4555 (wherein a tetO is at nucleotides 4250-4482 and a CMVmini promoter is at nucleotides 4496-4555), and a EBFP2 (enhanced blue fluorescent protein) encoding gene at nucleotides 4661-5380.

The pTRE-TALER14-4xT plasmid is as shown in SEQ ID NO: 79. In the SEQ ID NO: 79, from the 5' end it comprises a doxycycline responsive element TRE at nucleotides 67-334 (wherein a tetO is at nucleotides 67-262 and a CMVmini promoter is at nucleotides 277-334), and a TALER14 protein encoding gene at nucleotides 423-3560.

The pTRE-TALER21-4xT plasmid is as shown in SEQ ID NO: 80. In the SEQ ID NO: 80, from the 5' end it comprises a doxycycline responsive element TRE at nucleotides 67-334 (wherein a tetO is at nucleotides 67-262 and a CMVmini promoter is at nucleotides 277-334), and a TALER21 protein encoding gene at nucleotides 423-3764.

The pT14+T14+72_TALER21 plasmid is as shown in SEQ ID NO: 81. In the SEQ ID NO: 81, from the 5' end it comprises a 5×UAS sequence at nucleotides 4275-4367, a T14 sequence at nucleotides 4383-4399, a CMVmini promoter at nucleotides 4406-4465, a T14 sequence at nucleotides 4472-4488, and a TALER21 protein encoding gene at nucleotides 4574-7915.

The pT14+T14x3+72_TALER21 plasmid is as shown in SEQ ID NO: 82. In the SEQ ID NO: 82, from the 5' end it comprises a 5×UAS sequence at nucleotides 4275-4367, a T14 sequence at nucleotides 4383-4399, a CMVmini promoter at nucleotides 4406-4465, a T14 sequence at nucleotides 4472-4488, a T14 sequence at nucleotides 4489-4505, a T14 sequence at nucleotides 4506-4522, and a TALER21 protein encoding gene at nucleotides 4608-7949.

The pT21+T21+72_TALER14 plasmid is as shown in SEQ ID NO: 83. In the SEQ ID NO: 83, from the 5' end it comprises a 5×UAS sequence at nucleotides 4275-4367, a T21 sequence at nucleotides 4383-4401, a CMVmini promoter at nucleotides 4408-4467, a T21 sequence at nucleotides 4474-4492, and a TALER14 protein encoding gene at nucleotides 4578-7715.

The pT21+T21x3+72_TALER14 plasmid is as shown in SEQ ID NO: 84. In the SEQ ID NO: 84, from the 5' end it comprises a 5×UAS sequence at nucleotides 4275-4367, a T21 sequence at nucleotides 4383-4401, a CMVmini promoter at nucleotides 4408-4467, a T21 sequence at nucleotides 4474-4492, a T21 sequence at nucleotides 4493-4511, a T21 sequence at nucleotides 4512-4530, and a TALER14 protein encoding gene at nucleotides 4616-7753.

The pCAG-EYFP plasmid is as shown in SEQ ID NO: 85. In the SEQ ID NO: 85, from the 5' end it comprises a CAG promoter at nucleotides 3320-3997 and a EYFP (enhanced yellow fluorescent protein) encoding gene at nucleotides 5064-5783.

I. Experiment 1

Figure 9:
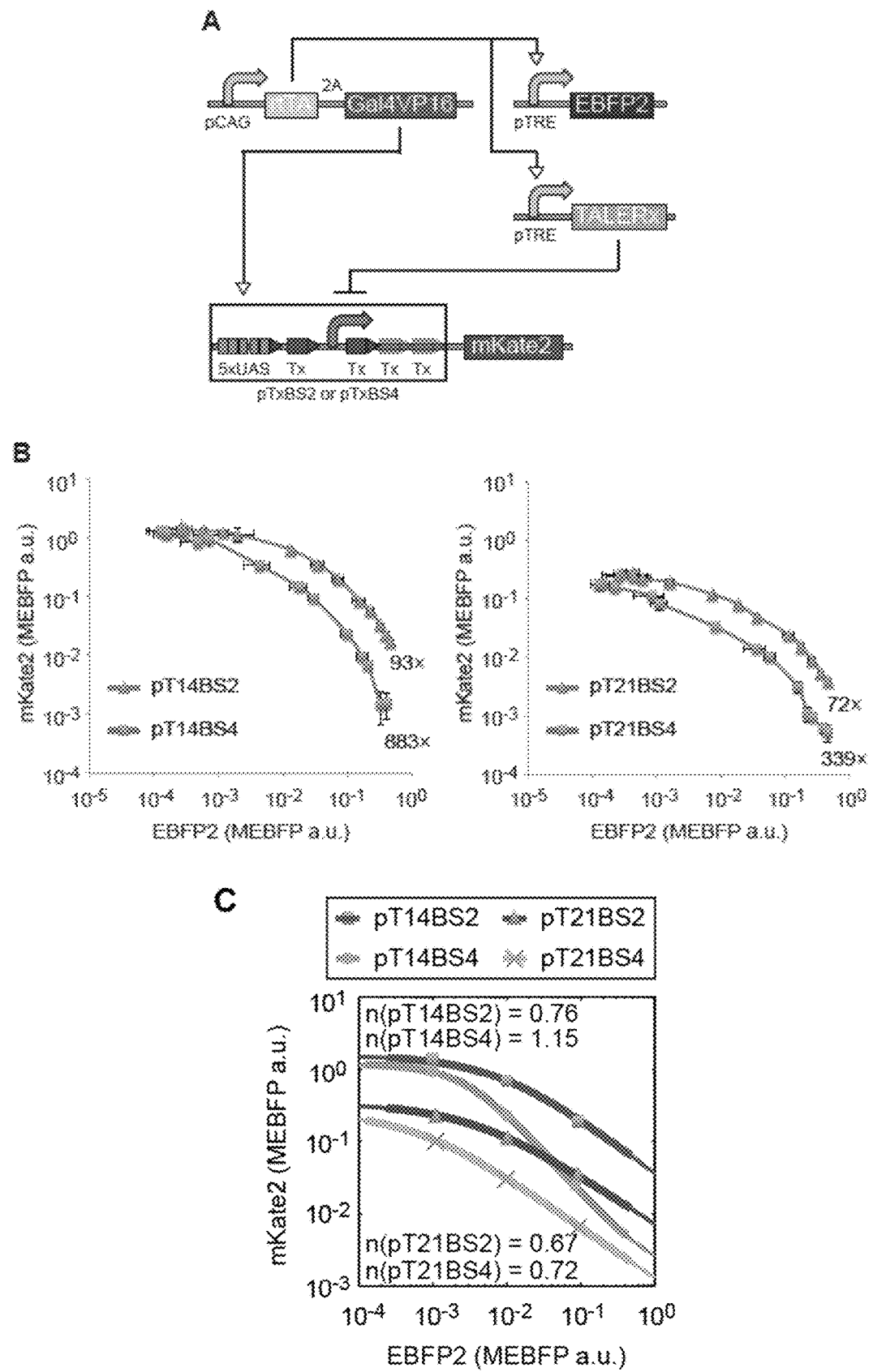
FIG. 9 is the result of step one in Example 3.

With the TALER protein tools that have good orthogonality and strong inhibitory effect, the inventors characterized dose response of the TALER proteins (see FIG. 9A for a schematic representation of the procedures).

In the absence of doxycycline (DOX), Gal4/vp16 and rtTA were expressed under the effect of the CAG promoter, Gal4/vp16 binding to the 5×UAS sequence activated the transcriptional initiation of the CMVmini promoter (the upstream of the CMVmini promoter has one Tx and its downstream has one or three Tx; Tx was illustrated using T14 or T21) and mKate2 was expressed. After the addition of doxycycline, doxycycline bound to rtTA to activate the doxycycline response element TRE, then TALER proteins (TALER proteins were illustrated using TALER14 protein or TALER21 protein) and EBFP2 were expressed; the TALER proteins binding to Tx sequences played a role of a transcriptional repression by steric hindrance, and the CMVmini promoter between the Tx sequences was inactivated and thereby the expression of mKate2 was inhibited. The expression of TALER proteins under the induction of Dox was estimated by the expression level of EBFP2, while the expression level variation of mKate2 reflected the inhibitory effect of TALER proteins on the CMVmini promoter between the Tx sequences.

The pCAG-rtTA-2A-Gal4/vp16 plasmid, pTRE-EBFP2 plasmid, pTRE-TALER14-4xT plasmid, pT14+T14+72-mKate2 plasmid and pCAG-EYFP plasmid were co-transfected into HEK293 cells (each well was transfected with 100 ng pCAG-rtTA-2A-Gal4/vp16 plasmid, 50 ng pTRE-EBFP2 plasmid, 50 ng pTRE-TALER14-4xT plasmid, 100 ng pT14+T14+72-mKate2 plasmid and 50 ng pCAG-EYFP plasmid); in the meantime of transfection, DOX was added in the cell culture system (such that the concentration of DOX was 0.1, 0.2, 0.5, 1, 2, 5, 10, 20, 50, 100, 200, 500, or 1000 ng/mL; set a blank control without DOX added as 0 ng/mL). After 48 hours of transfection, flow cytometry analysis was performed and the fluorescence intensities of mKate2, EBFP2 and EYFP were detected.

The method of cell transfection with plasmids is as follows: take a 24-well plate; 0.5 mL of HEK293 cell suspension (containing 6×10$^4$ HEK293 cells) is seeded into each well; after 24 hours of culture, replace with fresh DMEM culture medium; then transfect plasmids.

The above procedure was carried out using the pT14+T14x3+72-mKate2 plasmid in place of the pT14+T14+72-mKate2 plasmid.

The above procedure was carried out using the pT21+T21+72-mKate2 plasmid in place of the pT14+T14+72-mKate2 plasmid, and using the pTRE-TALER21-4xT plasmid in place of the pTRE-TALER14-4xT plasmid.

The above procedure was carried out using the pT21+T21x3+72-mKate2 plasmid in place of the pT14+T14+72-mKate2 plasmid, and using the pTRE-TALER21-4xT plasmid in place of the pTRE-TALER14-4xT plasmid.

The mKate2 fluorescence intensity/EYFP fluorescence intensity=Corrected mKate2 fluorescence intensity.

The EBFP2 fluorescence intensity/EYFP fluorescence intensity=Corrected EBFP2 fluorescence intensity.

See FIG. 9B for the results of corrected mKate2 fluorescence intensity and corrected EBFP2 fluorescence intensity (points from left to right represent increasing DOX concentrations; the maximal fold change is the ratio of the maximal mKate2 level to the minimal mKate2 level). At the downstream of the CMVmini promoter, the triple-binding site can enhance the inhibition efficiency of TALER proteins.

The transfer curve fitted using the Hill equation is shown in FIG. 9C, which provides a fine depiction of the output characteristics of TALER promoters responding to different concentrations of TALER proteins. n(pTxBS2) or n(pTxBS4) represents the Hill coefficient. The thick-line region represents the input range of experimental observations. The thin-line region represents the transfer curve speculated by the fitted Hill equation. The Hill coefficient ranged from 0.67 to 1.15, indicating that the combination of the TALER proteins and the corresponding promoters did not have strong synergistic effects.

II. Experiment 2

The inventors had developed and studied complex gene circuits using the TALER proteins as construction modules. Two TALER protein/promoter pairs were combined in series to form one TALER cascade (see FIG. 10A for a schematic representation of the structure). The input of the next TALER protein promoter corresponded to the output of the last TALER protein. When the first TALER protein was not expressed, the second TALER protein suppressed the output of the reporter gene (mKate2 gene). When DOX induced the expression of the first TALER protein, it could inhibit the expression of the second TALER protein, thereby releasing its inhibition on mKate2 and increasing the expression level of mKate2.

The pCAG-rtTA-2A-Gal4/vp16 plasmid, pTRE-EBFP2 plasmid, pTRE-TALER14-4xT plasmid, pT14+T14+72_TALER21 plasmid, pT21+T21+72-mKate2 plasmid and pCAG-EYFP plasmid were co-transfected into HEK293 cells (each well was transfected with 100 ng pCAG-rtTA-2A-Gal4/vp16 plasmid, 50 ng pTRE-EBFP2 plasmid, 50 ng pTRE-TALER14-4xT plasmid, 50 ng T14+T14+72_TALER21 plasmid, 100 ng pT21+T21+72-mKate2 plasmid and 50 ng pCAG-EYFP plasmid); in the meantime of transfection, DOX was added in the cell culture system (such that the concentration of DOX was 0.1, 0.2, 0.5, 1, 2, 5, 10, 20, 50, 100, 200, 500, or 1000 ng/mL; set a blank control without DOX added as 0 ng/mL). After 48 hours of transfection, flow cytometry analysis was performed and the fluorescence intensities of mKate2, EBFP2 and EYFP were detected. The method of cell transfection with plasmids is as follows: take a 24 well plate; 0.5 mL of HEK293 cell suspension (containing 6×10$^4$ HEK293 cells) is seeded into each well; after 24 hours of culture, replace with fresh DMEM culture medium; then transfect plasmids.

The above procedure was carried out using the pT14+T14x3+72_TALER21 plasmid in place of the pT14+T14+72_TALER21 plasmid.

The above procedure was carried out using the pT21+ T21x3+72-mKate2 plasmid in place of the pT21+T21+72-mKate2 plasmid.

The above procedure was carried out using the pT14+ T14x3+72_TALER21 plasmid in place of the pT14+T14+ 72_TALER21 plasmid, and using the pT21+T21x3+72-mKate2 plasmid in place of the pT21+T21+72-mKate2 plasmid.

The above procedure was carried out using the pT21+ T21+72_TALER14 plasmid in place of the pT14+T14+ 72_TALER21 plasmid, and using the pT14+T14+72-mKate2 plasmid in place of the pT21+T21+72-mKate2 plasmid.

The above procedure was carried out using the pT21+ T21x3+72_TALER14 plasmid in place of the pT14+T14+ 72_TALER21 plasmid, and using the pT14+T14+72-mKate2 plasmid in place of the pT21+T21+72-mKate2 plasmid.

The above procedure was carried out using the pT21+ T21+72_TALER14 plasmid in place of the pT14+T14+ 72_TALER21 plasmid, and using the pT14+T14x3+72-mKate2 plasmid in place of the pT21+T21+72-mKate2 plasmid.

The above procedure was carried out using the pT21+ T21x3+72_TALER14 plasmid in place of the pT14+T14+ 72_TALER21 plasmid, and using the pT14+T14x3+72-mKate2 plasmid in place of the pT21+T21+72-mKate2 plasmid.

The mKate2 fluorescence intensity/EYFP fluorescence intensity=Corrected mKate2 fluorescence intensity.

The EBFP2 fluorescence intensity/EYFP fluorescence intensity=Corrected EBFP2 fluorescence intensity.

Figure 10:
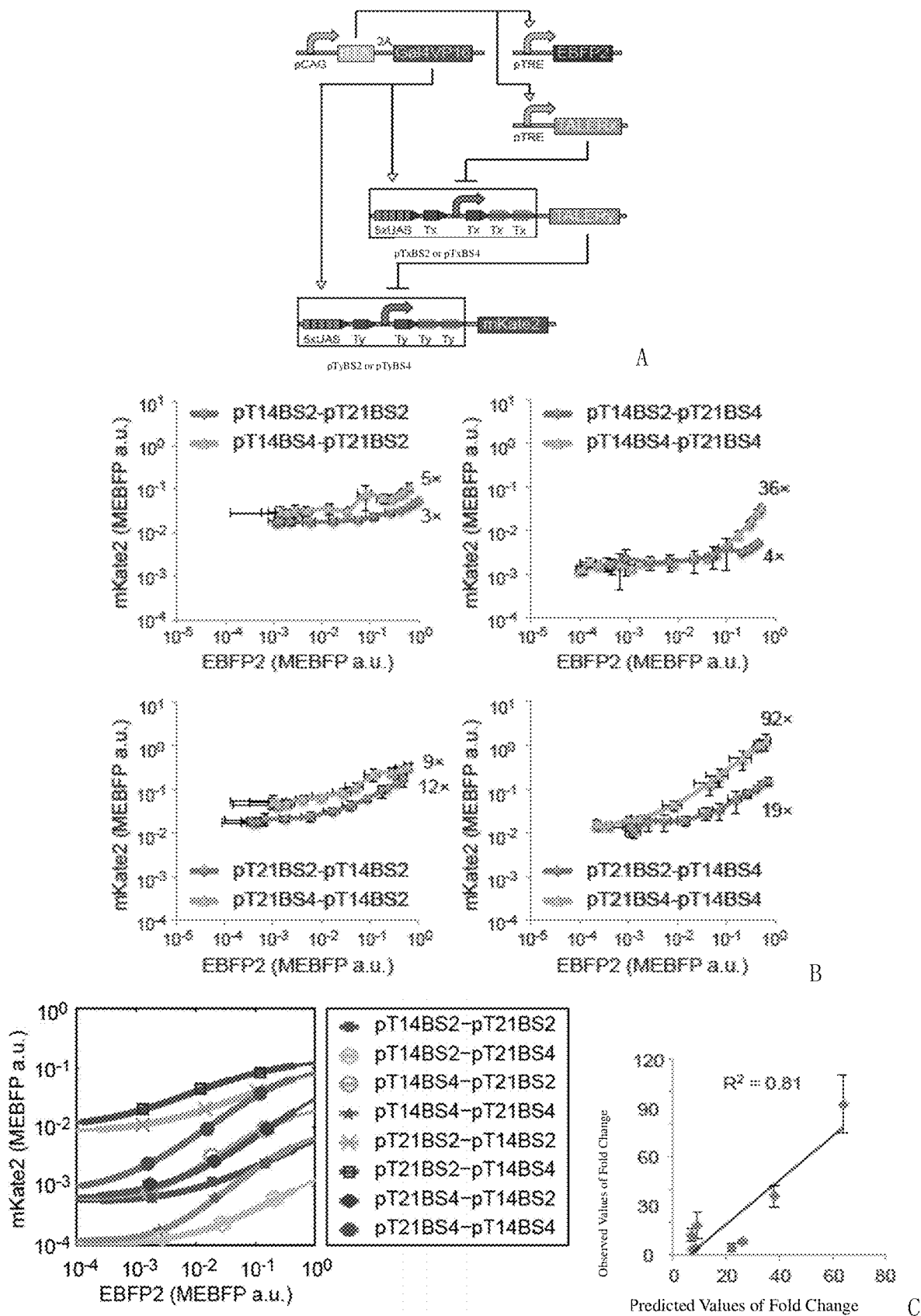
FIG. 10 is the result of step two in Example 3.

See FIG. 10B for the results of corrected mKate2 fluorescence intensity and corrected EBFP2 fluorescence intensity (points from left to right represent increasing DOX concentrations; the maximal fold change is the ratio of the maximal mKate2 to the minimal mKate2; the naming method of each cascade is "the name of the first level TALER—the name of the second level TALER"). The expression level of the reporter gene (mKate2 gene) increased as the concentration of DOX was increasing in all eight possible cascades constructed with the TALER14 protein and TALER21 protein/promoter, including two binding sites (pTxBS2) or four binding sites (pTxBS4). The difference between the maximum and minimum values of the output of the reporter gene ranged from 3 to 92 fold, demonstrating that these cascades have a particular dynamic range that is determined by the TALER protein module.

Figure 11:
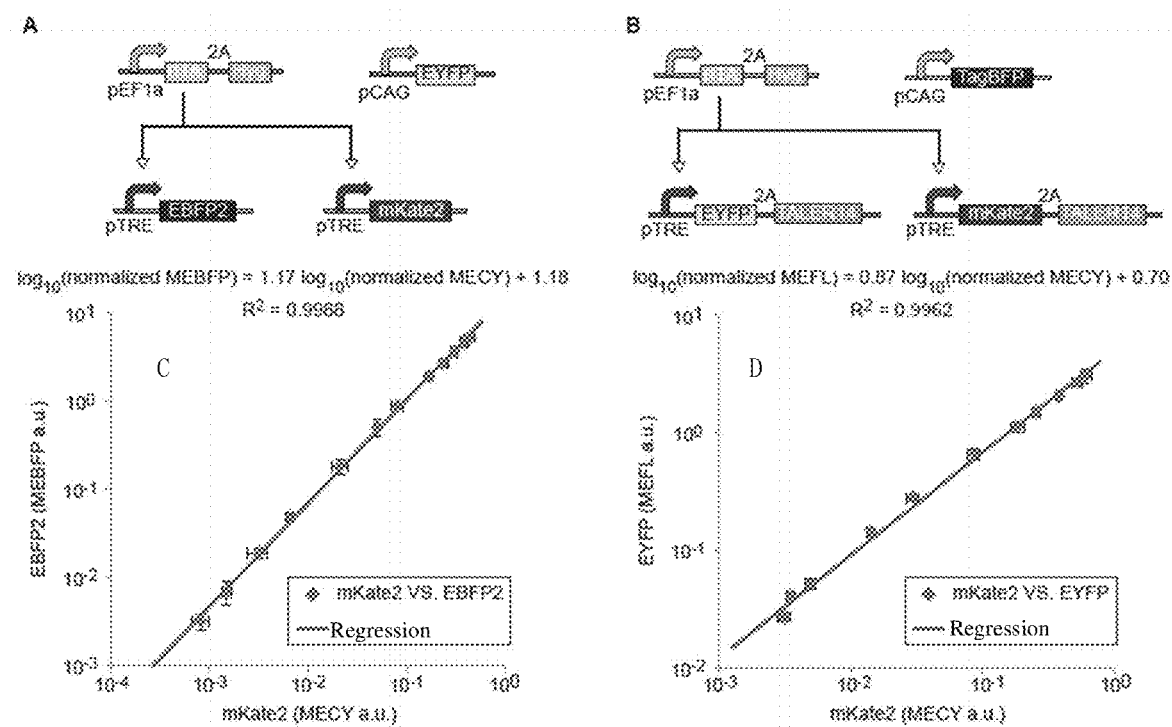
FIG. 11 is the result of step one in Example 4.

To test the ability to predict the TALER module, a colour model was established, which can convert the signal value of EBFP2 to the signal value of mKate2 and vice versa (FIG. 11A). The inventors then established a computational model for each cascade using the transfer function of its two TALER modules (FIG. 10C). The goodness of fit of correlation of the observed results and the predicted results was 0.81. These results strongly indicate that the inventors have the ability to construct the assembly of modular TALER cascades and quantitatively predict the output accelerating fold.

Example 4. Model Establishment

The inventors converted the corresponding fluorescence unit amount to the normalized unit amount using Rainbow Calibration Particles. For example, a linear relationship between MEFL and EYFP was established in the logarithmic domain using the peak value of the average EYFP fluorescence of the particles and its absolute MEFL unit amount. The linear relationships between MEBFP and Tag-BFP or EBFP2, between MECY and mKate2 or DsRed, and between MEAPCY7 and iRFP were also established in a similar way. The scatter diagram was plotted using the corrected data by means of the improved flow cytometry data reading and visualization tool in Matlab (MathWorks).

To compensate for the transfection efficiency differences of different samples, the inventors calculated the normalized fluorescence level (NFL) for a constitutively expressed reporter fluorescence by using a internal reference of transfection and using the following formula:

$$NFL = \frac{\text{mean}(FL) - \text{mean}(FL)(\text{non transfected control})}{\text{mean}(Control) - \text{mean}(Control)(\text{non transfected control})}$$

In the above formula, mean (FL) represents the mean value of MECY, MEFL or MEBFP in the tested cell population. Mean (Control) represents the mean value of the constitutively expressed reporter fluorescence in the tested cell population. The inventors then calculated the repression percentage and the repression fold using the following formula:

$$p = \frac{NFL(\text{no } TALER) | NFL(TALER)}{NFL(TALER)} \times 100\%$$

$$\text{Fold } c | ange = \frac{NFL(\text{no } TALER)}{NFL(TALER)}.$$

The pCAG-EYFP plasmid is the pCAG-EYFP plasmid in Example 3.

The pTRE-EBFP2 plasmid is the pTRE-EBFP2 plasmid in Example 3.

The pT21+T21x3+72-mKate2 plasmid is the pT21+ T21x3+72-mKate2 plasmid in Example 3.

The pT14+T14x3+72-mKate2 plasmid is the pT14+ T14x3+72-mKate2 plasmid in Example 3.

The pCAG-TagBFP plasmid is as shown in SEQ ID NO: 86. In the SEQ ID NO: 86, from the 5' end it comprises a CAG promoter at nucleotides 4253-4930 and a TagBFP (monomer blue fluorescent protein) encoding gene at nucleotides 6008-6700.

The pTRE-mKate2 plasmid is as shown in SEQ ID NO: 87. In the SEQ ID NO: 87, from the 5' end it comprises a doxycycline responsive element TRE at nucleotides 4250-4555 (wherein a tetO is at nucleotides 4250-4482 and a CMVmini promoter is at nucleotides 4496-4555), and a mKate2 encoding gene at nucleotides 4664-5369.

The pEF1a-rtTA-2A-Hyg plasmid is as shown in SEQ ID NO: 88. In the SEQ ID NO: 88, from the 5' end it comprises a pEF1a (promoter) at nucleotides 6207-7380, a rtTA encoding gene at nucleotides 7441-8184, a 2A linking peptide encoding gene at nucleotides 8185-8250, a Hyg gene (hygromycin resistant gene) at nucleotides 8263-9288.

The pTRE-EYFP-2A-TALER14 plasmid is as shown in SEQ ID NO: 89. In the SEQ ID NO: 89, from the 5' end it comprises a doxycycline responsive element TRE at nucleotides 4250-4555 (wherein a tetO is at nucleotides 4250-4482 and a CMVmini promoter is at nucleotides 4496-4555), a EYFP encoding gene at nucleotides 4676-5392, a 2A linking peptide encoding gene at nucleotides 5399-5452 and a TALER14 protein encoding gene at nucleotides 5462-8599.

The pTRE-mKate2-2A-TALER14 plasmid is as shown in SEQ ID NO: 90. In the SEQ ID NO: 90, from the 5' end it comprises a doxycycline responsive element TRE at nucleotides 4250-4555 (wherein a tetO is at nucleotides 4250-4482 and a CMVmini promoter is at nucleotides 4496-4555), a mKate2 encoding gene at nucleotides 4679-5371, a 2A linking peptide encoding gene at nucleotides 5378-5431 and a TALER14 protein encoding gene at nucleotides 5441-8578.

The pCAG-Gal4/vp16-2A-TagBFP-2A-B1a plasmid is as shown in SEQ ID NO: 91. In the SEQ ID NO: 91, from the 5' end it contains a CAG promoter at nucleotides 4253-5962, a Gal4/vp16 encoding gene at nucleotides 6016-6696, a 2A linking peptide encoding gene at nucleotides 6697-6762, a TagBFP encoding gene at nucleotides 6769-7458, and a 2A linking peptide encoding gene at nucleotides 7460-7518 and a B1a encoding gene at nucleotides 7519-7917.

The pT9+T9x3+72-mKate2 plasmid is as shown in SEQ ID NO: 92. In the SEQ ID NO: 92, from the 5' end it comprises a 5×UAS sequence at nucleotides 69-161, a T9 sequence (TALER9 protein target sequence) at nucleotides 177-197, a CMVmini promoter at nucleotides 204-263, a T9 sequence at nucleotides 270-290, a T9 sequence at nucleotides 291-311, a T9 sequence at nucleotides 312-332, and a mKate2 encoding gene at nucleotides 411-1129.

The pT10+T10x3+72-mKate2 plasmid is as shown in SEQ ID NO: 93. In the SEQ ID NO: 93, from the 5' end it comprises a 5×UAS sequence at nucleotides 69-161, a T10 sequence (TALER10 protein target sequence) at nucleotides 177-196, a CMVmini promoter at nucleotides 203-262, a T10 sequence at nucleotides 269-288, a T10 sequence at nucleotides 289-308, a T10 sequence at nucleotides 309-328, and a mKate2 encoding gene at nucleotides 407-1125.

The pT12+T12x3+72-mKate2 plasmid is as shown in SEQ ID NO: 94. In the SEQ ID NO: 94, from the 5' end it comprises a 5×UAS sequence at nucleotides 4275-4367, a T12 sequence (TALER12 protein target sequence) at nucleotides 4383-4400, a CMVmini promoter at nucleotides 4407-4466, a T12 sequence at nucleotides 4473-4490, a T12 sequence at nucleotides 4491-4508, a T12 sequence at nucleotides 4509-4526, and a mKate2 encoding gene at nucleotides 4576-5281.

The pTRE-EYFP-2A-TALER9 plasmid is as shown in SEQ ID NO: 95. In the SEQ ID NO: 95, from the 5' end it comprises a doxycycline responsive element TRE at nucleotides 4250-4555 (wherein a tetO is at nucleotides 4250-4482 and a CMVmini promoter is at nucleotides 4496-4555), a EYFP encoding gene at nucleotides 4676-5392, a 2A linking peptide encoding gene at nucleotides 5399-5452 and a TALER9 protein encoding gene at nucleotides 5462-9007.

The pTRE-EYFP-2A-TALER10 plasmid is as shown in SEQ ID NO: 96. In the SEQ ID NO: 96, from the 5' end it comprises a doxycycline responsive element TRE at nucleotides 4250-4555 (wherein a tetO is at nucleotides 4250-4482 and a CMVmini promoter is at nucleotides 4496-4555), a EYFP encoding gene at nucleotides 4676-5392, a 2A linking peptide encoding gene at nucleotides 5399-5452 and a TALER10 protein encoding gene at nucleotides 5462-8905.

The pTRE-EYFP-2A-TALER12 plasmid is as shown in SEQ ID NO: 97. In the SEQ ID NO: 97, from the 5' end it comprises a doxycycline responsive element TRE at nucleotides 4250-4555 (wherein a tetO is at nucleotides 4250-4482 and a CMVmini promoter is at nucleotides 4496-4555), a EYFP encoding gene at nucleotides 4676-5392, a 2A linking peptide encoding gene at nucleotides 5399-5452 and a TALER12 protein encoding gene at nucleotides 5462-8701.

The pTRE-EYFP-2A-TALER21 plasmid is as shown in SEQ ID NO: 98. In the SEQ ID NO: 98, from the 5' end it comprises a doxycycline responsive element TRE at nucleotides 4250-4555 (wherein a tetO is at nucleotides 4250-4482 and a CMVmini promoter is at nucleotides 4496-4555), a EYFP encoding gene at nucleotides 4676-5392, a 2A linking peptide encoding gene at nucleotides 5399-5452 and a TALER21 protein encoding gene at nucleotides 5468-8803.

I. Experiment 1

In order to establish a model to describe the mutual mapping relationship among different fluorescent proteins used in the input or output of the TALER modules, the inventors detected the reporter fluorescence intensity with or without 2A linking peptide using a DOX induction system (FIG. 11), and established the linear regression model of EYFP against EBFP2 or EYFP against mKate2 in the logarithm domain using the normalized fluorescence intensities, thereby achieving mutual transformation of the different reporter fluorescence unit amounts.

The pEF1a-rtTA-2A-Hyg plasmid, pCAG-EYFP plasmid, pTRE-EBFP2 plasmid, and pTRE-mKate2 plasmid were co-transfected into HEK293 cells (each well was transfected with 100 ng pEF1a-rtTA-2A-Hyg plasmid, 100 ng pCAG-EYFP plasmid, 100 ng pTRE-EBFP2 plasmid, and 100 ng pTRE-mKate2 plasmid); in the meantime of transfection, DOX was added in the cell culture system (such the concentration of DOX was 0.5, 1, 2, 5, 10, 20, 50, 100, 200, 500, or 1000 ng/mL; set a blank control without DOX added as 0 ng/mL). After 48 hours of transfection, flow cytometry analysis was performed and the fluorescence intensities of mKate2, EBFP2 and EYFP were detected. The method of cell transfection with plasmids is as follows: take a 24 well plate; 0.5 mL of HEK293 cell suspension (containing $6\times10^4$ HEK293 cells) is seeded into each well; after 24 hours of culture, replace with fresh DMEM culture medium; then transfect plasmids. The gene circuits used for the construction of EBFP2 and mKate2 transformation models are as shown in FIG. 11A. FIG. 11C shows the mutual relationship between the corrected EBFP and mKate2, and their linear regression equations are annotated at the top of the chart.

The pEF1a-rtTA-2A-Hyg plasmid, pCAG-TagBFP plasmid, pTRE-EYFP-2A-TALER14 plasmid, and pTRE-mKate2-2A-TALER14 plasmid were co-transfected into HEK293 cells (each well was transfected with 100 ng pEF1a-rtTA-2A-Hyg plasmid, 100 ng pCAG-TagBFP plasmid, 100 ng pTRE-EYFP-2A-TALER14 plasmid, and 100 ng pTRE-mKate2-2A-TALER14 plasmid); in the meantime of transfection, DOX was added in the cell culture system (such that the concentration of DOX was 0.5, 1, 2, 5, 10, 20, 50, 100, 200, 500, or 1000 ng/mL; set a blank control without DOX added as 0 ng/mL). After 48 hours of transfection, flow cytometry analysis was performed and the fluorescence intensities of mKate2, TagBFP and EYFP were detected. The method of cell transfection with plasmids is as follows: take a 24 well plate; 0.5 mL of HEK293 cell suspension (containing $6\times10^4$ HEK293 cells) is seeded into each well; after 24 hours of culture, replace with fresh DMEM culture medium; then transfect plasmids. The gene circuits used for the construction of EYFP and mKate2 normalized models are as shown in FIG. 11B. FIG. 11D shows the mutual relationship between the corrected EYFP and mKate2, and their linear regression equations are annotated at the top of the chart.

II. Experiment 2

Similar Dox inducing system was used to test the TALER transfer curve.

The pEF1a-rtTA-2A-Hyg plasmid, pCAG-Gal4/vp16-2A-TagBFP-2A-B1a plasmid, pTRE-EYFP-2A-TALER9 plasmid, and pT9+T9x3+72-mKate2 plasmid were co-transfected into HEK293 cells (each well was transfected with 100 ng pEF1a-rtTA-2A-Hyg plasmid, 100 ng pCAG-Gal4/vp16-2A-TagBFP-2A-B1a plasmid, 100 ng pTRE-EYFP-2A-TALER9 plasmid, and 100 ng pT9+T9x3+72-mKate2 plasmid); in the meantime of transfection, DOX was added in the cell culture system (such that the concentration of DOX was 0.5, 1, 2, 5, 10, 20, 50, 100, 200, 500, or 1000 ng/mL; set a blank control without DOX expressed as 0 ng/mL). After 48 hours of transfection, flow cytometry analysis was performed and the fluorescence intensities of mKate2, TagBFP and EYFP were detected. The method of cell transfection with plasmids is as follows: take a 24 well plate; 0.5 mL of HEK293 cell suspension (containing $6 \times 10^4$ HEK293 cells) is seeded into each well; after 24 hours of culture, replace with fresh DMEM culture medium; then transfect plasmids.

The above procedure was carried out using the pTRE-EYFP-2A-TALER10 plasmid in place of the pTRE-EYFP-2A-TALER9 plasmid, and using the pT10+T10x3+72-mKate2 plasmid in place of the pT9+T9x3+72-mKate2 plasmid.

The above procedure was carried out using the pTRE-EYFP-2A-TALER12 plasmid in place of the pTRE-EYFP-2A-TALER9 plasmid, and using the pT12+T12x3+72-mKate2 plasmid in place of the pT9+T9x3+72-mKate2 plasmid.

The above procedure was carried out using the pTRE-EYFP-2A-TALER14 plasmid in place of the pTRE-EYFP-2A-TALER9 plasmid, and using the pT14+T14x3+72-mKate2 plasmid in place of the pT9+T9x3+72-mKate2 plasmid.

The above procedure was carried out using the pTRE-EYFP-2A-TALER21 plasmid in place of the pTRE-EYFP-2A-TALER9 plasmid, and using the pT21+T21x3+72-mKate2 plasmid in place of the pT9+T9x3+72-mKate2 plasmid.

Figure 12:
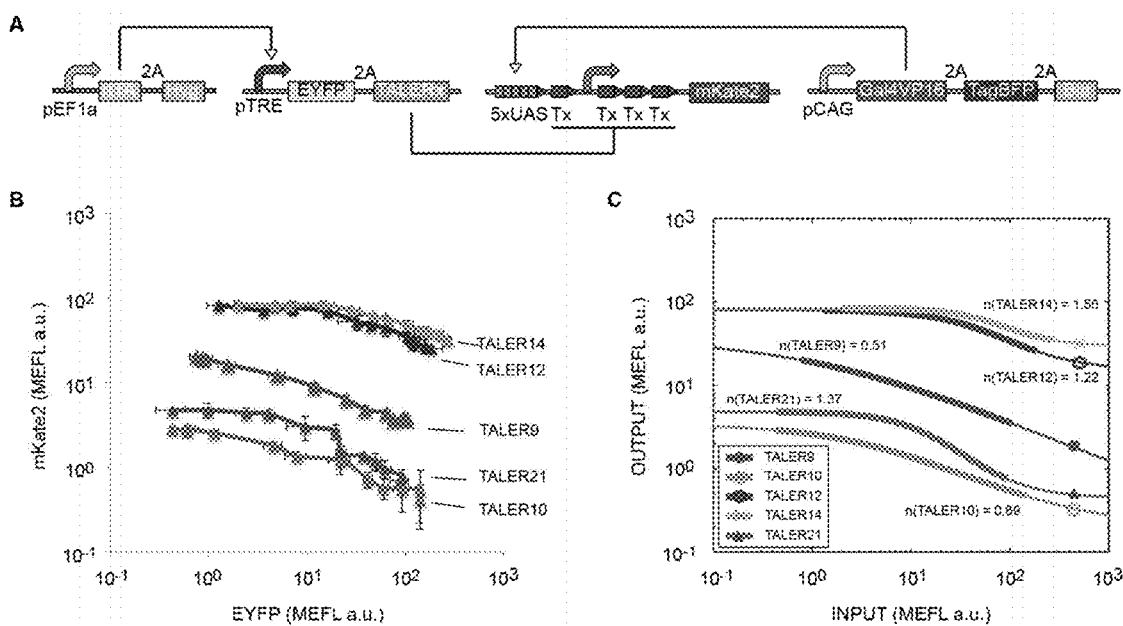
FIG. 12 is the result of step two in Example 4.

The gene circuits used for the analysis of transfer function curve are shown in FIG. 12A (the indicatrix with an arrow at the end represents a positive regulation effect and the indicatrix with a stub at the end represents a negative regulation effect).

The data points observed on the transfer function curve are shown in FIG. 12B. All reporter fluorescences were calibrated by Rainbow beads. Both EYFP and mKate2 were normalized with TagBFP as the internal reference. The mKate2 were numerically converted to EYFP in accordance with the linear regression equation shown in FIG. 11.

The transfer function curve fitted using the Hill equation is shown in FIG. 12C. n(TALERx) represents the Hill coefficient in the range of 0.51 to 1.56. The thick-line region represents the input range of experimental observations. The thin-line region represents the transfer function curve speculated by the fitted Hill equation.

Based on the assumption that the input and output of TALER reach a steady state at the time of detection, the following Hill equation model was established using the corrected and normalized fluorescence intensities:

$$\frac{dB}{dt} = \frac{\beta_2}{1+\left(\frac{A}{k}\right)^n} + \beta_1 - \gamma B = 0$$

In the above formula, B represents the output fluorescence intensity, A represents the fluorescence intensity of the input representing TALER concentration, $\beta_2$ represents the maximum production rate of the TALER promoter, $\beta_1$ represents the leakage production rate of the TALER promoter, k represents the input concentration at inhibition ratio of 50%, n represents the Hill coefficient, and y represents the decay rate.

For the prediction of cascade effect fold, the input and output of each TALER were normalized to MEBFP by linear interpolation, next the output of the first level TALER was used as the input of the second level TALER. Then gene circuits were simulated in the range of the first level TALER input tested by experiments, and the maximal fold change is calculated from the second-level TALER output.

In a nullcline analysis, a couple of TALER transfer curves were plotted on a graph, and the transfer curve of the second TALER was flipped along the y=x diagonal, which is equivalent to reversing its input and output. The intersection of the two transfer curves is the predictive equilibrium state after this pair of TALERs composed a switch, since all coordinate axes are normalized units.

Example 5. Modular Assembly of TALER Switches Controlled by Synthetic shRNA

The pCAG-Gal4/vp16-2A-TagBFP-2A-B1a plasmid is the pCAG-Gal4/vp16-2A-TagBFP-2A-B1a plasmid in Example 4.

The pT9+T9x3+72-mKate2-2A-TALER10-4xTarget^FF4 plasmid is as shown in SEQ ID NO: 99. In the SEQ ID NO: 99, from the 5' end it comprises a 5×UAS sequence at nucleotides 4275-4367, a T9 sequence (TALER9 protein target sequence) at nucleotides 4383-4403, a CMVmini promoter at nucleotides 4410-4469, a T9 sequence at nucleotides 4476-4496, a T9 sequence at nucleotides 4497-4517, a T9 sequence at nucleotides 4518-4538, a mKate2 encoding gene at nucleotides 4600-5295, a 2A linking peptide encoding gene at nucleotides 5302-5355, a TALER10 protein encoding gene at nucleotides 5365-8808, a shRNA-FF4 target sequence Target^FF4 at nucleotides 8887-8908, a shRNA-FF4 target sequence Target^FF4 at nucleotides 8909-8930, a shRNA-FF4 target sequence Target^FF4 at nucleotides 8931-8952, and a shRNA-FF4 target sequence Target^FF4 at nucleotides 8959-8980.

The pT9+T9x3+72-mKate2-2A-TALER12-4xTarget^FF6 plasmid is as shown in SEQ ID NO: 100. In the SEQ ID NO: 100, from the 5' end it comprises a 5×UAS sequence at nucleotides 4275-4367, a T9 sequence (TALER9 protein target sequence) at nucleotides 4383-4403, a CMVmini promoter at nucleotides 4410-4469, a T9 sequence at nucleotides 4476-4496, a T9 sequence at nucleotides 4497-4517, a T9 sequence at nucleotides 4518-4538, a mKate2 encoding gene at nucleotides 4600-5295, a 2A linking peptide encoding gene at nucleotides 5302-5355, a TALER12 protein encoding gene at nucleotides 5365-8604, a shRNA-FF6 target sequence Target^FF6 at nucleotides 8689-8710, a shRNA-FF6 target sequence Target^FF6 at nucleotides 8715-8731, a shRNA-FF6 target sequence Target^FF6 at nucleotides 8741-8762, and a shRNA-FF6 target sequence Target^FF6 at nucleotides 8767-8788.

The pT9+T9x3+72-mKate2-2A-TALER14-4xTarget^FF4 plasmid is as shown in SEQ ID NO: 101. In the SEQ ID NO: 101, from the 5' end it comprises a 5×UAS sequence at nucleotides 4275-4367, a T9 sequence (TALER9 protein target sequence) at nucleotides 4383-4403, a CMVmini promoter at nucleotides 4410-4469, a T9 sequence at nucleotides 4476-4496, a T9 sequence at nucleotides 4497-4517, a T9 sequence at nucleotides 4518-4538, a mKate2 encoding gene at nucleotides 4603-5295, a 2A linking peptide encoding gene at nucleotides 5302-5355, a TALER14 protein encoding gene at nucleotides 5365-8502, a shRNA-FF4 target sequence Target^FF4 at nucleotides 8593-8614, a shRNA-FF4 target sequence Target^FF4 at nucleotides 8615-8636, a shRNA-FF4 target sequence Target^FF4 at nucleotides 8637-8658, and a shRNA-FF4 target sequence Target^FF4 at nucleotides 8665-8686.

The pT9+T9x3+72-mKate2-2A-TALER21-4xTarget^FF3 plasmid is as shown in SEQ ID NO: 102. In the SEQ ID NO: 102, from the 5' end it comprises a 5×UAS sequence at nucleotides 4275-4367, a T9 sequence (TALER9 protein target sequence) at nucleotides 4383-4403, a CMVmini promoter at nucleotides 4410-4469, a T9 sequence at nucleotides 4476-4496, a T9 sequence at nucleotides 4497-4517, a T9 sequence at nucleotides 4518-4538, a mKate2 encoding gene at nucleotides 4600-5295, a 2A linking peptide encoding gene at nucleotides 5302-5355, a TALER21 protein encoding gene at nucleotides 5365-8706, a shRNA-FF3 target sequence Target^FF3 at nucleotides 8794-8814, a shRNA-FF3 target sequence Target^FF3 at nucleotides 8820-8840, a shRNA-FF3 target sequence Target^FF3 at nucleotides 8846-8866, and a shRNA-FF3 target sequence Target^FF3 at nucleotides 8872-8892.

The pT10+T10x3+72-EYFP-2A-TALER9-4xTarget^FF5 plasmid is as shown in SEQ ID NO: 103. In the SEQ ID NO: 103, from the 5' end it comprises a 5×UAS sequence at nucleotides 4275-4367, a T10 sequence (TALER10 protein target sequence) at nucleotides 4383-4402, a CMVmini promoter at nucleotides 4409-4468, a T10 sequence at nucleotides 4475-4494, a T10 sequence at nucleotides 4495-4514, a T10 sequence at nucleotides 4515-4534, a EYFP encoding gene at nucleotides 4596-5312, a 2A linking peptide encoding gene at nucleotides 5319-5372, a TALER9 protein encoding gene at nucleotides 5382-8927, a shRNA-FF5 target sequence Target^FF5 at nucleotides 9017-9038, a shRNA-FF5 target sequence Target^FF5 at nucleotides 9039-9060, a shRNA-FF5 target sequence Target^FF5 at nucleotides 9061-9082, and a shRNA-FF5 target sequence Target^FF5 at nucleotides 9083-9104.

The pT10+T10x3+72-mKate2-2A-TALER12-4xTarget^FF6 plasmid is as shown in SEQ ID NO: 104. In the SEQ ID NO: 104, from the 5' end it comprises a 5×UAS sequence at nucleotides 4275-4367, a T10 sequence (TALER10 protein target sequence) at nucleotides 4383-4402, a CMVmini promoter at nucleotides 4409-4468, a T10 sequence at nucleotides 4475-4494, a T10 sequence at nucleotides 4495-4514, a T10 sequence at nucleotides 4515-4534, a mKate2 encoding gene at nucleotides 4596-5291, a 2A linking peptide encoding gene at nucleotides 5298-5351, a TALER12 protein encoding gene at nucleotides 5361-8600, a shRNA-FF6 target sequence Target^FF6 at nucleotides 8685-8706, a shRNA-FF6 target sequence Target^FF6 at nucleotides 8711-8727, a shRNA-FF6 target sequence Target^FF6 at nucleotides 8737-8758, and a shRNA-FF6 target sequence Target^FF6 at nucleotides 8763-8784.

The pT10+T10x3+72-mKate2-2A-TALER14-4xTarget^FF4 plasmid is as shown in SEQ ID NO: 105. In the SEQ ID NO: 105, from the 5' end it comprises a 5×UAS sequence at nucleotides 4275-4367, a T10 sequence (TALER10 protein target sequence) at nucleotides 4383-4402, a CMVmini promoter at nucleotides 4409-4468, a T10 sequence at nucleotides 4475-4494, a T10 sequence at nucleotides 4495-4514, a T10 sequence at nucleotides 4515-4534, a mKate2 encoding gene at nucleotides 4599-5291, a 2A linking peptide encoding gene at nucleotides 5298-5351, a TALER14 protein encoding gene at nucleotides 5361-8498, a shRNA-FF4 target sequence Target^FF4 at nucleotides 8589-8610, a shRNA-FF4 target sequence Target^FF4 at nucleotides 8611-8632, a shRNA-FF4 target sequence Target^FF4 at nucleotides 8633-8654, and a shRNA-FF4 target sequence Target^FF4 at nucleotides 8661-8682.

The pT10+T10x3+72-mKate2-2A-TALER14-4xTarget^FF5 plasmid is as shown in SEQ ID NO: 106. In the SEQ ID NO: 106, from the 5' end it comprises a 5×UAS sequence at nucleotides 4275-4367, a T10 sequence (TALER10 protein target sequence) at nucleotides 4383-4402, a CMVmini promoter at nucleotides 4409-4468, a T10 sequence at nucleotides 4475-4494, a T10 sequence at nucleotides 4495-4514, a T10 sequence at nucleotides 4515-4534, a mKate2 encoding gene at nucleotides 4599-5291, a 2A linking peptide encoding gene at nucleotides 5298-5351, a TALER14 protein encoding gene at nucleotides 5361-8498, a shRNA-FF5 target sequence Target^FF5 at nucleotides 8589-8610, a shRNA-FF5 target sequence Target^FF5 at nucleotides 8611-8632, a shRNA-FF5 target sequence Target^FF5 at nucleotides 8633-8654, and a shRNA-FF5 target sequence Target^FF5 at nucleotides 8655-8676.

The pT10+T10x3+72-mKate2-2A-TALER21-4xTarget^FF3 plasmid is as shown in SEQ ID NO: 107. In the SEQ ID NO: 107, from the 5' end it comprises a 5×UAS sequence at nucleotides 4275-4367, a T10 sequence (TALER10 protein target sequence) at nucleotides 4383-4402, a CMVmini promoter at nucleotides 4409-4468, a T10 sequence at nucleotides 4475-4494, a T10 sequence at nucleotides 4495-4514, a T10 sequence at nucleotides 4515-4534, a mKate2 encoding gene at nucleotides 4599-5291, a 2A linking peptide encoding gene at nucleotides 5298-5351, a TALER21 protein encoding gene at nucleotides 5361-8702, a shRNA-FF3 target sequence Target^FF3 at nucleotides 8790-8810, a shRNA-FF3 target sequence Target^FF3 at nucleotides 8816-8836, a shRNA-FF3 target sequence Target^FF3 at nucleotides 8842-8862, and a shRNA-FF3 target sequence Target^FF3 at nucleotides 8868-8888.

The pT12+T12x3+72-EYFP-2A-TALER9-4xTarget^FF5 plasmid is as shown in SEQ ID NO: 108. In the SEQ ID NO: 108, from the 5' end it comprises a 5×UAS sequence at nucleotides 4275-4367, a T12 sequence (TALER12 protein target sequence) at nucleotides 4383-4400, a CMVmini promoter at nucleotides 4407-4466, a T12 sequence at nucleotides 4473-4490, a T12 sequence at nucleotides 4491-4508, a T12 sequence at nucleotides 4509-4526, a EYFP encoding gene at nucleotides 4588-5304, a 2A linking peptide encoding gene at nucleotides 5311-5364, a TALER9 protein encoding gene at nucleotides 5374-8919, a shRNA-FF5 target sequence Target^FF5 at nucleotides 9009-9030, a shRNA-FF5 target sequence Target^FF5 at nucleotides 9031-9052, a shRNA-FF5 target sequence Target^FF5 at nucleotides 9053-9074, and a shRNA-FF5 target sequence Target^FF5 at nucleotides 9075-9096.

The pT12+T12x3+72-EYFP-2A-TALER10-4xTarget^FF4 plasmid is as shown in SEQ ID NO: 109. In the SEQ ID NO: 109, from the 5' end it comprises a 5×UAS sequence at nucleotides 4275-4367, a T12 sequence (TALER12 protein target sequence) at nucleotides 4383-4400, a CMVmini promoter at nucleotides 4407-4466, a T12 sequence at nucleotides 4473-4490, a T12 sequence at nucleotides 4491-4508, a T12 sequence at nucleotides 4509-4526, a EYFP encoding gene at nucleotides 4588-5304, a 2A linking peptide encoding gene at nucleotides 5311-5364, a TALER10 protein encoding gene at nucleotides 5374-8817, a shRNA-FF4 target sequence Target^FF4 at nucleotides 8896-8917, a shRNA-FF4 target sequence Target^FF4 at nucleotides 8918-8939, a shRNA-FF4 target sequence Target^FF4 at nucleotides 8940-8961, and a shRNA-FF4 target sequence Target^FF4 at nucleotides 8968-8989.

The pT12+T12x3+72-mKate2-2A-TALER14-4xTarget^FF4 plasmid is as shown in SEQ ID NO: 110. In the SEQ ID NO: 110, from the 5' end it comprises a 5×UAS sequence at nucleotides 4275-4367, a T12 sequence (TALER12 protein target sequence) at nucleotides 4383-4400, a CMVmini promoter at nucleotides 4407-4466, a T12 sequence at nucleotides 4473-4490, a T12 sequence at nucleotides 4491-4508, a T12 sequence at nucleotides 4509-4526, a mKate2 encoding gene at nucleotides 4591-5283, a 2A linking peptide encoding gene at nucleotides 5290-5343, a TALER14 protein encoding gene at nucleotides 5353-8490, a shRNA-FF4 target sequence Target^FF4 at nucleotides 8581-8602, a shRNA-FF4 target sequence Target^FF4 at nucleotides 8603-8624, a shRNA-FF4 target sequence Target^FF4 at nucleotides 8625-8646, and a shRNA-FF4 target sequence Target^FF4 at nucleotides 8653-8674.

The pT12+T12x3+72-mKate2-2A-TALER21-4xTarget^FF3 plasmid is as shown in SEQ ID NO: 111. In the SEQ ID NO: 111, from the 5' end it comprises a 5×UAS sequence at nucleotides 4275-4367, a T12 sequence (TALER12 protein target sequence) at nucleotides 4383-4400, a CMVmini promoter at nucleotides 4407-4466, a T12 sequence at nucleotides 4473-4490, a T12 sequence at nucleotides 4491-4508, a T12 sequence at nucleotides 4509-4526, a mKate2 encoding gene at nucleotides 4588-5283, a 2A linking peptide encoding gene at nucleotides 5290-5343, a TALER21 protein encoding gene at nucleotides 5353-8694, a shRNA-FF3 target sequence Target^FF3 at nucleotides 8782-8802, a shRNA-FF3 target sequence Target^FF3 at nucleotides 8808-8828, a shRNA-FF3 target sequence Target^FF3 at nucleotides 8834-8854, and a shRNA-FF3 target sequence Target^FF3 at nucleotides 8860-8880.

The pT14+T14x3+72-EYFP-2A-TALER9-4xTarget^FF5 plasmid is as shown in SEQ ID NO: 112. In the SEQ ID NO: 112, from the 5' end it comprises a 5×UAS sequence at nucleotides 4275-4367, a T14 sequence (TALER14 protein target sequence) at nucleotides 4383-4399, a CMVmini promoter at nucleotides 4406-4465, a T14 sequence at nucleotides 4472-4488, a T14 sequence at nucleotides 4489-4505, a T14 sequence at nucleotides 4506-4522, a EYFP encoding gene at nucleotides 4584-5300, a 2A linking peptide encoding gene at nucleotides 5307-5360, a TALER9 protein encoding gene at nucleotides 5370-8915, a shRNA-FF5 target sequence Target^FF5 at nucleotides 9005-9026, a shRNA-FF5 target sequence Target^FF5 at nucleotides 9027-9048, a shRNA-FF5 target sequence Target^FF5 at nucleotides 9049-9070, and a shRNA-FF5 target sequence Target^FF5 at nucleotides 9071-9092.

The pT14+T14x3+72-EYFP-2A-TALER12-4xTarget^FF5 plasmid is as shown in SEQ ID NO: 113. In the SEQ ID NO: 113, from the 5' end it comprises a 5×UAS sequence at nucleotides 4275-4367, a T14 sequence (TALER14 protein target sequence) at nucleotides 4383-4399, a CMVmini promoter at nucleotides 4406-4465, a T14 sequence at nucleotides 4472-4488, a T14 sequence at nucleotides 4489-4505, a T14 sequence at nucleotides 4506-4522, a EYFP encoding gene at nucleotides 4584-5300, a 2A linking peptide encoding gene at nucleotides 5307-5360, a TALER12 protein encoding gene at nucleotides 5370-8609, a shRNA-FF5 target sequence Target^FF5 at nucleotides 8699-8720, a shRNA-FF5 target sequence Target^FF5 at nucleotides 8721-8742, a shRNA-FF5 target sequence Target^FF5 at nucleotides 8743-8764, and a shRNA-FF5 target sequence Target^FF5 at nucleotides 8765-8786.

The pT14+T14x3+72-mKate2-2A-TALER21-4xTarget^FF3 plasmid is as shown in SEQ ID NO: 114. In the SEQ ID NO: 114, from the 5' end it comprises a 5×UAS sequence at nucleotides 4275-4367, a T14 sequence (TALER14 protein target sequence) at nucleotides 4383-4399, a CMVmini promoter at nucleotides 4406-4465, a T14 sequence at nucleotides 4472-4488, a T14 sequence at nucleotides 4489-4505, a T14 sequence at nucleotides 4506-4522, a mKate2 encoding gene at nucleotides 4584-5279, a 2A linking peptide encoding gene at nucleotides 5286-5339, a TALER21 protein encoding gene at nucleotides 5349-8690, a shRNA-FF3 target sequence Target^FF3 at nucleotides 8778-8798, a shRNA-FF3 target sequence Target^FF3 at nucleotides 8804-8824, a shRNA-FF3 target sequence Target^FF3 at nucleotides 8830-8850, and a shRNA-FF3 target sequence Target^FF3 at nucleotides 8856-8876.

The pT21+T21x3+72-EYFP-2A-TALER14-4xTarget^FF4 plasmid is as shown in SEQ ID NO: 115. In the SEQ ID NO: 115, from the 5' end it comprises a 5×UAS sequence at nucleotides 4275-4367, a T21 sequence (TALER21 protein target sequence) at nucleotides 4383-4401, a CMVmini promoter at nucleotides 4408-4467, a T21 sequence at nucleotides 4474-4492, a T21 sequence at nucleotides 4493-4511, a T21 sequence at nucleotides 4512-4530, a EYFP encoding gene at nucleotides 4592-5308, a 2A linking peptide encoding gene at nucleotides 5315-5368, a TALER14 protein encoding gene at nucleotides 5378-8515, a shRNA-FF4 target sequence Target^FF4 at nucleotides 8606-8627, a shRNA-FF4 target sequence Target^FF4 at nucleotides 8628-8649, a shRNA-FF4 target sequence Target^FF4 at nucleotides 8650-8671, and a shRNA-FF4 target sequence Target^FF4 at nucleotides 8678-8699.

The pT21+T21x3+72-EYFP-2A-TALER9-4xTarget^FF5 plasmid is as shown in SEQ ID NO: 116. In the SEQ ID NO: 116, from the 5' end it comprises a 5×UAS sequence at nucleotides 4275-4367, a T21 sequence (TALER21 protein target sequence) at nucleotides 4383-4401, a CMVmini promoter at nucleotides 4408-4467, a T21 sequence at nucleotides 4474-4490, a T21 sequence at nucleotides 4491-4509, a T21 sequence at nucleotides 4510-4530, a EYFP encoding gene at nucleotides 4592-5308, a 2A linking peptide encoding gene at nucleotides 5315-5368, a TALER9 protein encoding gene at nucleotides 5378-8923, a shRNA-FF5 target sequence Target^FF5 at nucleotides 9013-9034, a shRNA-FF5 target sequence Target^FF5 at nucleotides 9035-9056, a shRNA-FF5 target sequence Target^FF5 at nucleotides 9057-9078, and a shRNA-FF5 target sequence Target^FF5 at nucleotides 9079-9100.

The pT21+T21x3+72-EYFP-2A-TALER10-4xTarget^FF4 plasmid is as shown in SEQ ID NO: 117. In the SEQ ID NO: 117, from the 5' end it comprises a 5×UAS sequence at nucleotides 4275-4367, a T21 sequence (TALER21 protein target sequence) at nucleotides 4383-4401, a CMVmini promoter at nucleotides 4408-4467, a T21 sequence at nucleotides 4474-4492, a T21 sequence at nucleotides 4493-4511, a T21 sequence at nucleotides 4512-4530, a EYFP encoding gene at nucleotides 4592-5308, a 2A linking peptide encoding gene at nucleotides 5315-5368, a TALER10 protein encoding gene at nucleotides 5378-8821, a shRNA-FF4 target sequence Target^FF4 at nucleotides 8900-8921, a shRNA-FF4 target sequence Target^FF4 at nucleotides 8922-8943, a shRNA-FF4 target sequence Target^FF4 at nucleotides 8944-8965, and a shRNA-FF4 target sequence Target^FF4 at nucleotides 8972-8993.

The pT21+T21x3+72-EYFP-2A-TALER12-4xTarget^FF5 plasmid is as shown in SEQ ID NO: 118. In the SEQ ID NO: 118, from the 5' end it comprises a 5×UAS sequence at nucleotides 4275-4367, a T21 sequence (TALER21 protein target sequence) at nucleotides 4383-4401, a CMVmini promoter at nucleotides 4408-4467, a T21 sequence at nucleotides 4474-4492, a T21 sequence at nucleotides 4493-4511, a T21 sequence at nucleotides 4512-4530, a EYFP encoding gene at nucleotides 4592-5308, a 2A linking peptide encoding gene at nucleotides 5315-5368, a TALER12 protein encoding gene at nucleotides 5378-8617, a shRNA-FF5 target sequence Target^FF5 at nucleotides 8707-8728, a shRNA-FF5 target sequence Target^FF5 at nucleotides 8729-8750, a shRNA-FF5 target sequence Target^FF5 at nucleotides 8751-8772, and a shRNA-FF5 target sequence Target^FF5 at nucleotides 8773-8794.

The pT14+T14x3+72-EYFP-2A-TALER10-4xTarget^FF4 plasmid is as shown in SEQ ID NO: 119. In the SEQ ID NO: 119, from the 5' end it comprises a 5×UAS sequence at nucleotides 4275-4367, a T14 sequence (TALER14 protein target sequence) at nucleotides 4383-4399, a CMVmini promoter at nucleotides 4406-4465, a T14 sequence at nucleotides 4472-4488, a T14 sequence at nucleotides 4489-4505, a T14 sequence at nucleotides 4506-4522, a EYFP encoding gene at nucleotides 4584-5300, a 2A linking peptide encoding gene at nucleotides 5307-5360, a TALER10 protein encoding gene at nucleotides 5370-8813, a shRNA-FF4 target sequence Target^FF4 at nucleotides 8892-8913, a shRNA-FF4 target sequence Target^FF4 at nucleotides 8914-8935, a shRNA-FF4 target sequence Target^FF4 at nucleotides 8936-8957, and a shRNA-FF4 target sequence Target^FF4 at nucleotides 8964-8985.

The pSIREN_U6-shRNA-FF3 plasmid is as shown in SEQ ID NO: 120. In the SEQ ID NO: 120, from the 5' end it comprises a U6 promoter at nucleotides 229-477, a shRNA-FF3 encoding gene at nucleotides 484-536, a CMV IE promoter at nucleotides 741-1329 and a iRFP (near-infrared fluorescent protein) encoding gene at nucleotides 1361-2311.

The pSIREN_U6-shRNA-FF4 plasmid is as shown in SEQ ID NO: 121. In the SEQ ID NO: 121, from the 5' end it comprises a U6 promoter at nucleotides 229-477, a shRNA-FF4 encoding gene at nucleotides 484-536, a CMV IE promoter at nucleotides 741-1329 and a iRFP (near-infrared fluorescent protein) encoding gene at nucleotides 1361-2311.

The pSIREN_U6-shRNA-FF5 plasmid is as shown in SEQ ID NO: 122. In the SEQ ID NO: 122, from the 5' end it comprises a U6 promoter at nucleotides 229-477, a shRNA-FF5 encoding gene at nucleotides 484-536, a CMV IE promoter at nucleotides 741-1329 and a iRFP (near-infrared fluorescent protein) encoding gene at nucleotides 1361-2311.

The pSIREN_U6-shRNA-FF6 plasmid is as shown in SEQ ID NO: 123. In the SEQ ID NO: 123, from the 5' end it comprises a U6 promoter at nucleotides 229-477, a shRNA-FF6 encoding gene at nucleotides 484-536, a CMV IE promoter at nucleotides 741-1329 and a iRFP (near-infrared fluorescent protein) encoding gene at nucleotides 1361-2311.

The shRNA-FF3, shRNA-FF4, shRNA-FF5, and shRNA-FF6 all are shRNA.

Gene switches are essential to the fate determination of mammalian cells. A synthetic gene switch is composed of two elements that are mutually inhibited in transcription, and the switch can achieve state transitions through the repression of one of the transcriptional repression elements by an external signal molecule. With the TALER proteins with highly efficient transcriptional repression, the inventors constructed TALER switches using two mutually-inhibited TALER proteins as modules, and controlled the state of the TALER switches using microRNA/shRNA as signals (FIG. 13A, wave line represents shRNA, small squares represent shRNA target sites). The TALER9 protein, the TALER10 protein, the TALER12 protein, the TALER14 protein, and the TALER21 protein, which had strong inhibition and strong orthogonality in the previous analyses, were selected as modules for constructing the TALER protein switches. Double gene expression vectors were formed by linking the TALER proteins with the mKate2 or EYFP fluorescent reporter gene by the self-cleavage peptide 2A.

I. Experiment 1

The nullcline analysis was performed by plotting the output-input transfer function curve of each TALER protein against all the other TALER proteins.

The pCAG-Gal4/vp16-2A-TagBFP-2A-B1a plasmid, pT10+T10x3+72-EYFP-2A-TALER9-4xTarget^FF5 plasmid, and pT9+T9x3+72-mKate2-2A-TALER10-4xTarget^FF4 plasmid were co-transfected into HEK293 cells (each well was transfected with 100 ng pCAG-Gal4/vp16-2A-TagBFP-2A-B1a plasmid, 100 ng pT10+T10x3+72-EYFP-2A-TALER9-4xTarget^FF5 plasmid, and 100 ng pT9+T9x3+72-mKate2-2A-TALER10-4xTarget^FF4 plasmid). After 48 hours of transfection, flow cytometry analysis was performed and the fluorescence intensities of mKate2, TagBFP and EYFP were detected. The method of cell transfection with plasmids is as follows: take a 24-well plate; 0.5 mL of HEK293 cell suspension (containing 6×10$^4$ HEK293 cells) is seeded into each well; after 24 hours of culture, replace with fresh DMEM culture medium; then transfect plasmids.

The method of cell transfection with plasmids is as follows: take a 24-well plate; 0.5 mL of HEK293 cell suspension (containing 6×10$^4$ HEK293 cells) is seeded into each well; after 24 hours of culture, replace with fresh DMEM culture medium; then transfect plasmids.

The above procedure was carried out using the pT12+T12x3+72-EYFP-2A-TALER9-4xTarget^FF5 plasmid in place of the pT10+T10x3+72-EYFP-2A-TALER9-4xTarget^FF5 plasmid, and using the pT9+T9x3+72-mKate2-2A-TALER12-4xTarget^FF6 plasmid in place of the pT9+T9x3+72-mKate2-2A-TALER10-4xTarget^FF4 plasmid.

The above procedure was carried out using the pT14+T14x3+72-EYFP-2A-TALER9-4xTarget^FF5 plasmid in place of the pT10+T10x3+72-EYFP-2A-TALER9-4xTarget^FF5 plasmid, and using the pT9+T9x3+72-mKate2-2A-TALER14-4xTarget^FF4 plasmid in place of the pT9+T9x3+72-mKate2-2A-TALER10-4xTarget^FF4 plasmid.

The above procedure was carried out using the pT21+T21x3+72-EYFP-2A-TALER9-4xTarget^FF5 plasmid in place of the pT10+T10x3+72-EYFP-2A-TALER9-4xTarget^FF5 plasmid, and using the pT9+T9x3+72-mKate2-2A-TALER21-4xTarget^FF3 plasmid in place of the pT9+T9x3+72-mKate2-2A-TALER10-4xF4 plasmid.

The above procedure was carried out using the pT12+T12x3+72-EYFP-2A-TALER10-4xTarget^FF4 plasmid in place of the pT10+T10x3+72-EYFP-2A-TALER9-4xTarget^FF5 plasmid, and using the pT10+T10x3+72-mKate2-2A-TALER12-4xTarget^FF6 plasmid in place of the pT9+T9x3+72-mKate2-2A-TALER10-4xF4 plasmid.

The above procedure was carried out using the pT14+T14x3+72-EYFP-2A-TALER10-4xTarget^FF4 plasmid in place of the pT10+T10x3+72-EYFP-2A-TALER9-4xTarget^FF5 plasmid, and using the pT10+T10x3+72-mKate2-2A-TALER14-4xTarget^FF5 plasmid in place of the pT9+T9x3+72-mKate2-2A-TALER10-4xTarget^FF4 plasmid.

The above procedure was carried out using the pT21+T21x3+72-EYFP-2A-TALER10-4xTarget^FF4 plasmid in place of the pT10+T10x3+72-EYFP-2A-TALER9-4xTarget^FF5 plasmid, and using the pT10+T10x3+72-mKate2-2A-TALER21-4xTarget^FF3 plasmid in place of the pT9+T9x3+72-mKate2-2A-TALER10-4xTarget^FF4 plasmid.

The above procedure was carried out using the pT14+T14x3+72-EYFP-2A-TALER12-4xTarget^FF5 plasmid in place of the pT10+T10x3+72-EYFP-2A-TALER9-4xTarget^FF5 plasmid, and using the pT12+T12x3+72-mKate2-2A-TALER14-4xTarget^FF4 plasmid in place of the pT9+T9x3+72-mKate2-2A-TALER10-4xTarget^FF4 plasmid.

The above procedure was carried out using the pT21+T21x3+72-EYFP-2A-TALER12-4xTarget^FF5 plasmid in place of the pT10+T10x3+72-EYFP-2A-TALER9-4xTarget^FF5 plasmid, and using the pT12+T12x3+72-mKate2-2A-TALER21-4xTarget^FF3 plasmid in place of the pT9+T9x3+72-mKate2-2A-TALER10-4xTarget^FF4 plasmid.

The above procedure was carried out using the pT21+T21x3+72-EYFP-2A-TALER14-4xTarget^FF4 plasmid in place of the pT10+T10x3+72-EYFP-2A-TALER9-4xTarget^FF5 plasmid, and using the pT14+T14x3+72-mKate2-2A-TALER21-4xTarget^FF3 plasmid in place of the pT9+T9x3+72-mKate2-2A-TALER10-4xTarget^FF4 plasmid.

Figure 13:
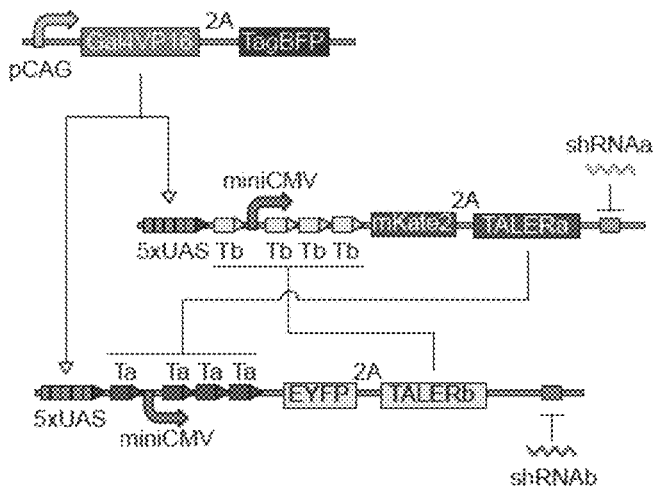
FIG. 13 is the result of step one in Example 5.
Figure 13:
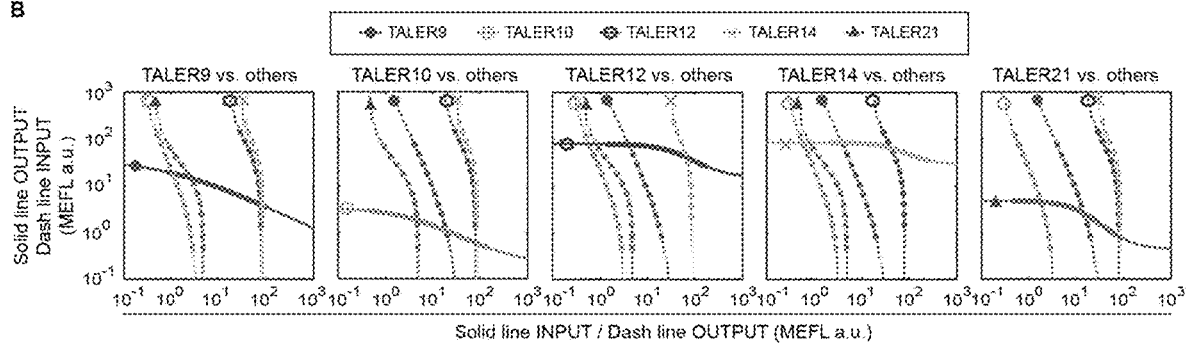
Figure 13:
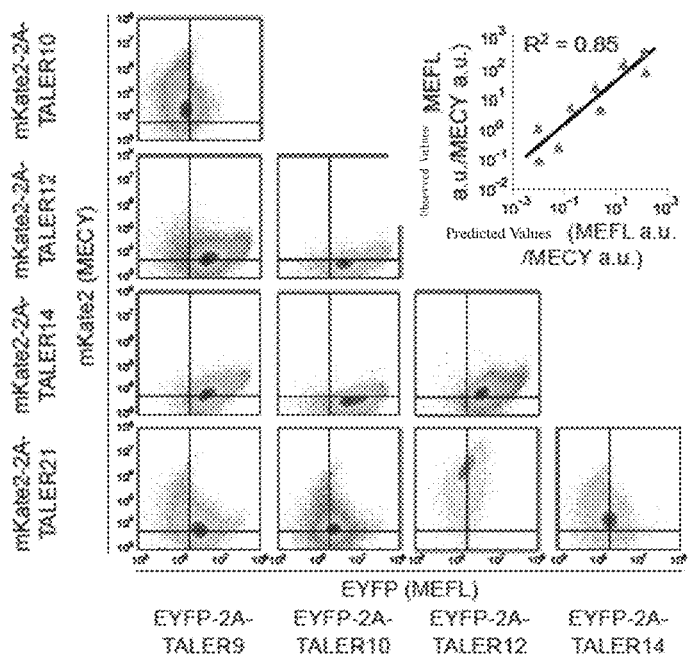

See FIG. 13C for results. The matrix shows representative flow cytometric scatter diagrams in which the annotation in each row is the same TALER protein linked to mKate2 in the transfection experiments and the annotation in each column is the same TALER protein linked to EYFP in the transfection experiments. The ratio of EYFP and mKate2 obtained by the experiments and that predicted by the nullcline analyses have good correlation, and the goodness of fit is 0.85. This indicated that the nullcline analyses derived from the experiments can guide the design of the TALER switches.

The nullcline analyses of the TALER switches were carried out based on the fitted transfer curve by the Hill equation are shown in FIG. 13B (both solid line and dash line represent TALER transfer curve, in which the horizontal axis of the dash line corresponds to the output and the vertical axis corresponds to the input; the thick-line region represents the input range of the experimental observations, and the thin-line region represents the speculated transfer curve by the fitted Hill equation, and the intersection point represents the equilibrium state of the TALER switches. The tested TALER switches usually have two results. The first, the same as expected, is that the two TALERs are unbalanced, then the TALER switch tends to produce a strong TALER module output while the weaker module output is inhibited; the second is that the two TALERs are balanced, then both outputs tends to be inhibited.

II. Experiment 2

The method of cell transfection with plasmids is as follows: take a 24-well plate; 0.5 mL of HEK293 cell suspension (containing $6\times10^4$ HEK293 cells) is seeded into each well; after 24 hours of culture, replace with fresh DMEM culture medium; then transfect plasmids.

The mKate2 fluorescence intensity/TagBFP fluorescence intensity=the corrected mKate2 fluorescence intensity. The EYFP fluorescence intensity/TagBFP fluorescence intensity=the corrected EYFP fluorescence intensity. The corrected mKate2 fluorescence intensity and the corrected EYFP fluorescence intensity were used in both FIG. 14 and FIG. 15.

1. Group One: The pCAG-Gal4/vp16-2A-TagBFP-2A-B1a plasmid, pT9+T9x3+72-mKate2-2A-TALER10-4xTarget^FF4 plasmid, and pT10+T10x3+72-EYFP-2A-TALER9-4xTarget^FF5 plasmid were co-transfected into HEK293 cells (each well was transfected with 100 ng pCAG-Gal4/vp16-2A-TagBFP-2A-B1a plasmid, 100 ng pT9+T9x3+72-mKate2-2A-TALER10-4xTarget^FF4 plasmid, and 100 ng pT10+T10x3+72-EYFP-2A-TALER9-4xTarget^FF5 plasmid); Group Two: The pCAG-Gal4/vp16-2A-TagBFP-2A-B1a plasmid, pT9+T9x3+72-mKate2-2A-TALER10-4xTarget^FF4 plasmid, pT10+T10x3+72-EYFP-2A-TALER9-4xTarget^FF5 plasmid, and pSIREN_U6-shRNA-FF5 plasmid were co-transfected into HEK293 cells (each well was transfected with 100 ng pCAG-Gal4/vp16-2A-TagBFP-2A-B1a plasmid, 100 ng pT9+T9x3+72-mKate2-2A-TALER10-4xTarget^FF4 plasmid, 100 ng pT10+T10x3+72-EYFP-2A-TALER9-4xTarget^FF5 plasmid, and 100 ng pSIREN_U6-shRNA-FF5 plasmid); Group Three: The same as the Group Two except that the same quantity of the pSIREN_U6-shRNA-FF4 plasmid is used to replace the pSIREN_U6-shRNA-FF5 plasmid; After 48 hours of transfection, flow cytometry analysis was performed and the fluorescence intensities of mKate2, TagBFP and EYFP were detected. See FIG. 14A for results.

2. Group One: The pCAG-Gal4/vp16-2A-TagBFP-2A-B1a plasmid, pT9+T9x3+72-mKate2-2A-TALER12-4xTarget^FF6 plasmid, and pT12+T12x3+72-EYFP-2A-TALER9-4xTarget^FF5 plasmid were co-transfected into HEK293 cells (each well was transfected with 100 ng pCAG-Gal4/vp16-2A-TagBFP-2A-B1a plasmid, 100 ng pT9+T9x3+72-mKate2-2A-TALER12-4xTarget^FF6 plasmid, and 100 ng pT12+T12x3+72-EYFP-2A-TALER9-4xTarget^FF5 plasmid); Group Two: The pCAG-Gal4/vp16-2A-TagBFP-2A-B1a plasmid, pT9+T9x3+72-mKate2-2A-TALER12-4xTarget^FF6 plasmid, pT12+T12x3+72-EYFP-2A-TALER9-4xTarget^FF5 plasmid, and pSIREN_U6-shRNA-FF5 plasmid were co-transfected into HEK293 cells (each well was transfected with 100 ng pCAG-Gal4/vp16-2A-TagBFP-2A-B1a plasmid, 100 ng pT9+T9x3+72-mKate2-2A-TALER12-4xTarget^FF6 plasmid, 100 ng pT12+T12x3+72-EYFP-2A-TALER9-4xTarget^FF5 plasmid, and 100 ng pSIREN_U6-shRNA-FF5 plasmid); Group Three: The same as the Group Two except that the same quantity of the pSIREN_U6-shRNA-FF6 plasmid is used to replace the pSIREN_U6-shRNA-FF5 plasmid; After 48 hours of transfection, flow cytometry analysis was performed and the fluorescence intensities of mKate2, TagBFP and EYFP were detected. See FIG. 14B for results.

3. Group One: The pCAG-Gal4/vp16-2A-TagBFP-2A-B1a plasmid, pT9+T9x3+72-mKate2-2A-TALER14-4xTarget^FF4 plasmid, and pT14+T14x3+72-EYFP-2A-TALER9-4xTarget^FF5 plasmid were co-transfected into HEK293 cells (each well was transfected with 100 ng pCAG-Gal4/vp16-2A-TagBFP-2A-B1a plasmid, 100 ng pT9+T9x3+72-mKate2-2A-TALER14-4xTarget^FF4 plasmid, and 100 ng pT14+T14x3+72-EYFP-2A-TALER9-4xTarget^FF5 plasmid); Group Two: The pCAG-Gal4/vp16-2A-TagBFP-2A-B1a plasmid, pT9+T9x3+72-mKate2-2A-

TALER14-4xTargetˆFF4 plasmid, pT14+T14x3+72-EYFP-2A-TALER9-4xTargetˆFF5 plasmid, and pSIREN_U6-shRNA-FF5 plasmid were co-transfected into HEK293 cells (each well was transfected with 100 ng pCAG-Gal4/vp16-2A-TagBFP-2A-B1a plasmid, 100 ng pT9+T9x3+72-mKate2-2A-TALER14-4xTargetˆFF4 plasmid, 100 ng pT14+T14x3+72-EYFP-2A-TALER9-4xTargetˆFF5 plasmid, and 100 ng pSIREN_U6-shRNA-FF5 plasmid); Group Three: The same as the Group Two except that the same quantity of the pSIREN_U6-shRNA-FF4 plasmid is used to replace the pSIREN_U6-shRNA-FF5 plasmid; After 48 hours of transfection, flow cytometry analysis was performed and the fluorescence intensities of mKate2, TagBFP and EYFP were detected. See FIG. 14C for results.

4. Group One: The pCAG-Gal4/vp16-2A-TagBFP-2A-B1a plasmid, pT9+T9x3+72-mKate2-2A-TALER21-4xTargetˆFF3 plasmid, and pT21+T21x3+72-EYFP-2A-TALER9-4xTargetˆFF5 plasmid were co-transfected into HEK293 cells (each well was transfected with 100 ng pCAG-Gal4/vp16-2A-TagBFP-2A-B1a plasmid, 100 ng pT9+T9x3+72-mKate2-2A-TALER21-4xTargetˆFF3 plasmid, and 100 ng pT21+T21x3+72-EYFP-2A-TALER9-4xTargetˆFF5 plasmid); Group Two: The pCAG-Gal4/vp16-2A-TagBFP-2A-B1a plasmid, pT9+T9x3+72-mKate2-2A-TALER21-4xTargetˆFF3 plasmid, pT21+T21x3+72-EYFP-2A-TALER9-4xTargetˆFF5 plasmid, and pSIREN_U6-shRNA-FF5 plasmid were co-transfected into HEK293 cells (each well was transfected with 100 ng pCAG-Gal4/vp16-2A-TagBFP-2A-B1a plasmid, 100 ng pT9+T9x3+72-mKate2-2A-TALER21-4xTargetˆFF3 plasmid, 100 ng pT21+T21x3+72-EYFP-2A-TALER9-4xTargetˆFF5 plasmid, and 100 ng pSIREN_U6-shRNA-FF5 plasmid); Group Three: The same as the Group Two except that the same quantity of the pSIREN_U6-shRNA-FF3 plasmid is used to replace the pSIREN_U6-shRNA-FF5 plasmid; After 48 hours of transfection, flow cytometry analysis was performed and the fluorescence intensities of mKate2, TagBFP and EYFP were detected. See FIG. 14D for results.

5. Group One: The pCAG-Gal4/vp16-2A-TagBFP-2A-B1a plasmid, pT10+T10x3+72-mKate2-2A-TALER12-4xTargetˆFF6 plasmid, and pT12+T12x3+72-EYFP-2A-TALER10-4xTargetˆFF4 plasmid were co-transfected into HEK293 cells (each well was transfected with 100 ng pCAG-Gal4/vp16-2A-TagBFP-2A-B1a plasmid, 100 ng pT10+T10x3+72-mKate2-2A-TALER12-4xTargetˆFF6 plasmid, and 100 ng pT12+T12x3+72-EYFP-2A-TALER10-4xTargetˆFF4 plasmid); Group Two: The pCAG-Gal4/vp16-2A-TagBFP-2A-B1a plasmid, pT10+T10x3+72-mKate2-2A-TALER12-4xTargetˆFF6 plasmid, pT12+T12x3+72-EYFP-2A-TALER10-4xTargetˆFF4 plasmid, and pSIREN_U6-shRNA-FF4 plasmid were co-transfected into HEK293 cells (each well was transfected with 100 ng pCAG-Gal4/vp16-2A-TagBFP-2A-B1a plasmid, 100 ng pT10+T10x3+72-mKate2-2A-TALER12-4xTargetˆFF6 plasmid, 100 ng pT12+T12x3+72-EYFP-2A-TALER10-4xTargetˆFF4 plasmid, and 100 ng pSIREN_U6-shRNA-FF4 plasmid); Group Three: The same as the Group Two except that the same quantity of the pSIREN_U6-shRNA-FF6 plasmid is used to replace the pSIREN_U6-shRNA-FF4 plasmid; After 48 hours of transfection, flow cytometry analysis was performed and the fluorescence intensities of mKate2, TagBFP and EYFP were detected. See FIG. 15C for results.

6. Group One: The pCAG-Gal4/vp16-2A-TagBFP-2A-B1a plasmid, pT10+T10x3+72-mKate2-2A-TALER14-4xTargetˆFF5 plasmid, and pT14+T14x3+72-EYFP-2A-TALER10-4xTargetˆFF4 plasmid were co-transfected into HEK293 cells (each well was transfected with 100 ng pCAG-Gal4/vp16-2A-TagBFP-2A-B1a plasmid, 100 ng pT10+T10x3+72-mKate2-2A-TALER14-4xTargetˆFF5 plasmid, and 100 ng pT14+T14x3+72-EYFP-2A-TALER10-4xTargetˆFF4 plasmid); Group Two: The pCAG-Gal4/vp16-2A-TagBFP-2A-B1a plasmid, pT10+T10x3+72-mKate2-2A-TALER14-4xTargetˆFF5 plasmid, pT14+T14x3+72-EYFP-2A-TALER10-4xTargetˆFF4 plasmid, and pSIREN_U6-shRNA-FF4 plasmid were co-transfected into HEK293 cells (each well was transfected with 100 ng pCAG-Gal4/vp16-2A-TagBFP-2A-B1a plasmid, 100 ng pT10+T10x3+72-mKate2-2A-TALER14-4xTargetˆFF5 plasmid, 100 ng pT14+T14x3+72-EYFP-2A-TALER10-4xTargetˆFF4 plasmid, and 100 ng pSIREN_U6-shRNA-FF4 plasmid); Group Three: The same as the Group Two except that the same quantity of the pSIREN_U6-shRNA-FF5 plasmid is used to replace the pSIREN_U6-shRNA-FF4 plasmid; After 48 hours of transfection, flow cytometry analysis was performed and the fluorescence intensities of mKate2, TagBFP and EYFP were detected. See FIG. 15D for results.

7. Group One: The pCAG-Gal4/vp16-2A-TagBFP-2A-B1a plasmid, pT10+T10x3+72-mKate2-2A-TALER21-4xTargetˆFF3 plasmid, and pT21+T21x3+72-EYFP-2A-TALER10-4xTargetˆFF4 plasmid were co-transfected into HEK293 cells (each well was transfected with 100 ng pCAG-Gal4/vp16-2A-TagBFP-2A-B1a plasmid, 100 ng pT10+T10x3+72-mKate2-2A-TALER21-4xTargetˆFF3 plasmid, and 100 ng pT21+T21x3+72-EYFP-2A-TALER10-4xTargetˆFF4 plasmid); Group Two: The pCAG-Gal4/vp16-2A-TagBFP-2A-B1a plasmid, pT10+T10x3+72-mKate2-2A-TALER21-4xTargetˆFF3 plasmid, pT21+T21x3+72-EYFP-2A-TALER10-4xTargetˆFF4 plasmid, and pSIREN_U6-shRNA-FF4 plasmid were co-transfected into HEK293 cells (each well was transfected with 100 ng pCAG-Gal4/vp16-2A-TagBFP-2A-B1a plasmid, 100 ng pT10+T10x3+72-mKate2-2A-TALER21-4xTargetˆFF3 plasmid, 100 ng pT21+T21x3+72-EYFP-2A-TALER10-4xTargetˆFF4 plasmid, and 100 ng pSIREN_U6-shRNA-FF4 plasmid); Group Three: The same as the Group Two except that the same quantity of the pSIREN_U6-shRNA-FF3 plasmid is used to replace the pSIREN_U6-shRNA-FF4 plasmid; After 48 hours of transfection, flow cytometry analysis was performed and the fluorescence intensities of mKate2, TagBFP and EYFP were detected. See FIG. 15E for results.

8. Group One: The pCAG-Gal4/vp16-2A-TagBFP-2A-B1a plasmid, pT12+T12x3+72-mKate2-2A-TALER14-4xTargetˆFF4 plasmid, and pT14+T14x3+72-EYFP-2A-TALER12-4xTargetˆFF5 plasmid were co-transfected into HEK293 cells (each well was transfected with 100 ng pCAG-Gal4/vp16-2A-TagBFP-2A-B1a plasmid, 100 ng pT12+T12x3+72-mKate2-2A-TALER14-4xTargetˆFF4 plasmid, and 100 ng pT14+T14x3+72-EYFP-2A-TALER12-4xTargetˆFF5 plasmid); Group Two: The pCAG-Gal4/vp16-2A-TagBFP-2A-B1a plasmid, pT12+T12x3+72-mKate2-2A-TALER14-4xTargetˆFF4 plasmid, pT14+T14x3+72-EYFP-2A-TALER12-4xTargetˆFF5 plasmid, and pSIREN_U6-shRNA-FF5 plasmid were co-transfected into HEK293 cells (each well was transfected with 100 ng pCAG-Gal4/vp16-2A-TagBFP-2A-B1a plasmid, 100 ng pT12+T12x3+72-mKate2-2A-TALER14-4xTargetˆFF4 plasmid, 100 ng pT14+T14x3+72-EYFP-2A-TALER12-4xTargetˆFF5 plasmid, and 100 ng pSIREN_U6-shRNA-FF5 plasmid); Group Three: The same as the Group Two except that the same quantity of the pSIREN_U6-shRNA-FF4 plasmid is used to replace the pSIREN_U6-shRNA-FF5 plasmid; After 48 hours of transfection, flow cytometry analysis was performed and the fluorescence intensities of mKate2, TagBFP and EYFP were detected. See FIG. 15A for results.

9. Group One: The pCAG-Gal4/vp16-2A-TagBFP-2A-B1a plasmid, pT12+T12x3+72-mKate2-2A-TALER21-4xTargetˆFF3 plasmid, and pT21+T21x3+72-EYFP-2A-TALER12-4xTargetˆFF5 plasmid were co-transfected into HEK293 cells (each well was transfected with 100 ng pCAG-Gal4/vp16-2A-TagBFP-2A-B1a plasmid, 100 ng pT12+T12x3+72-mKate2-2A-TALER21-4xTargetˆFF3 plasmid, and 100 ng pT21+T21x3+72-EYFP-2A-TALER12-4xTargetˆFF5 plasmid); Group Two: The pCAG-Gal4/vp16-2A-TagBFP-2A-B1a plasmid, pT12+T12x3+72-mKate2-2A-TALER21-4xTargetˆFF3 plasmid, pT21+T21x3+72-EYFP-2A-TALER12-4xTargetˆFF5 plasmid, and pSIREN_U6-shRNA-FF5 plasmid were co-transfected into HEK293 cells (each well was transfected with 100 ng pCAG-Gal4/vp16-2A-TagBFP-2A-B1a plasmid, 100 ng pT12+T12x3+72-mKate2-2A-TALER21-4xTargetˆFF3 plasmid, 100 ng pT21+T21x3+72-EYFP-2A-TALER12-4xTargetˆFF5 plasmid, and 100 ng pSIREN_U6-shRNA-FF5 plasmid); Group Three: The same as the Group Two except that the same quantity of the pSIREN_U6-shRNA-FF3 plasmid is used to replace the pSIREN_U6-shRNA-FF5 plasmid; After 48 hours of transfection, flow cytometry analysis was performed and the fluorescence intensities of mKate2, TagBFP and EYFP were detected. See FIG. 15B for results.

10. Group One: The pCAG-Gal4/vp16-2A-TagBFP-2A-B1a plasmid, pT14+T14x3+72-mKate2-2A-TALER21-4xTargetˆFF3 plasmid, and pT21+T21x3+72-EYFP-2A-TALER14-4xTargetˆFF4 plasmid were co-transfected into HEK293 cells (each well was transfected with 100 ng pCAG-Gal4/vp16-2A-TagBFP-2A-B1a plasmid, 100 ng pT14+T14x3+72-mKate2-2A-TALER21-4xTargetˆFF3 plasmid, and 100 ng pT21+T21x3+72-EYFP-2A-TALER14-4xTargetˆFF4 plasmid); Group Two: The pCAG-Gal4/vp16-2A-TagBFP-2A-B1a plasmid, pT14+T14x3+72-mKate2-2A-TALER21-4xTargetˆFF3 plasmid, pT21+T21x3+72-EYFP-2A-TALER14-4xTargetˆFF4 plasmid, and pSIREN_U6-shRNA-FF4 plasmid were co-transfected into HEK293 cells (each well was transfected with 100 ng pCAG-Gal4/vp16-2A-TagBFP-2A-B1a plasmid, 100 ng pT14+T14x3+72-mKate2-2A-TALER21-4xTargetˆFF3 plasmid, 100 ng pT21+T21x3+72-EYFP-2A-TALER14-4xTargetˆFF4 plasmid, and 100 ng pSIREN_U6-shRNA-FF4 plasmid); Group Three: The same as the Group Two except that the same quantity of the pSIREN_U6-shRNA-FF3 plasmid is used to replace the pSIREN_U6-shRNA-FF4 plasmid; After 48 hours of transfection, flow cytometry analysis was performed and the fluorescence intensities of mKate2, TagBFP and EYFP were detected. See FIG. 14E for results.

Figure 14:
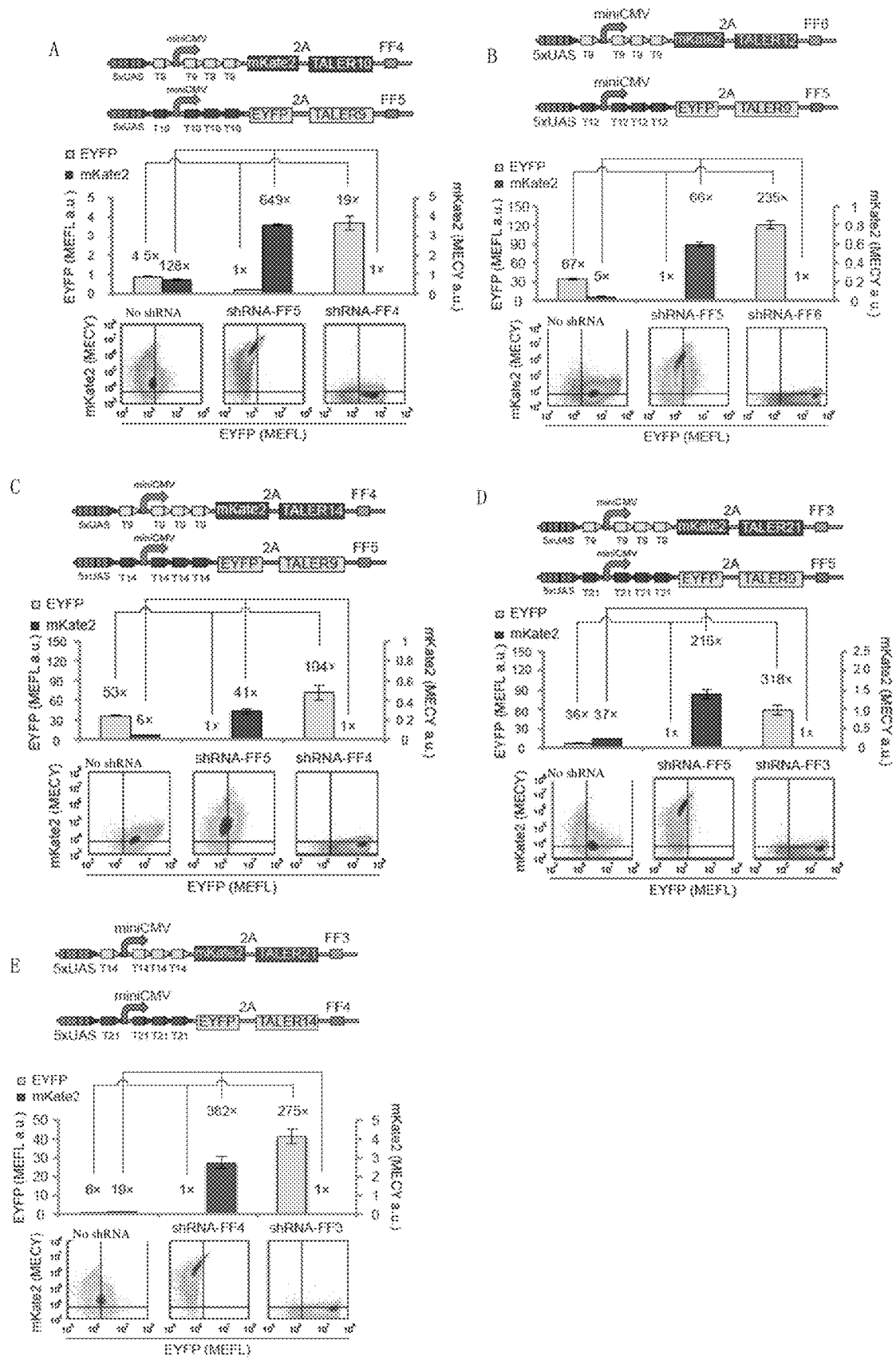
FIG. 14 and FIG. 15 are the results of step two in Example 5.
Figure 15:
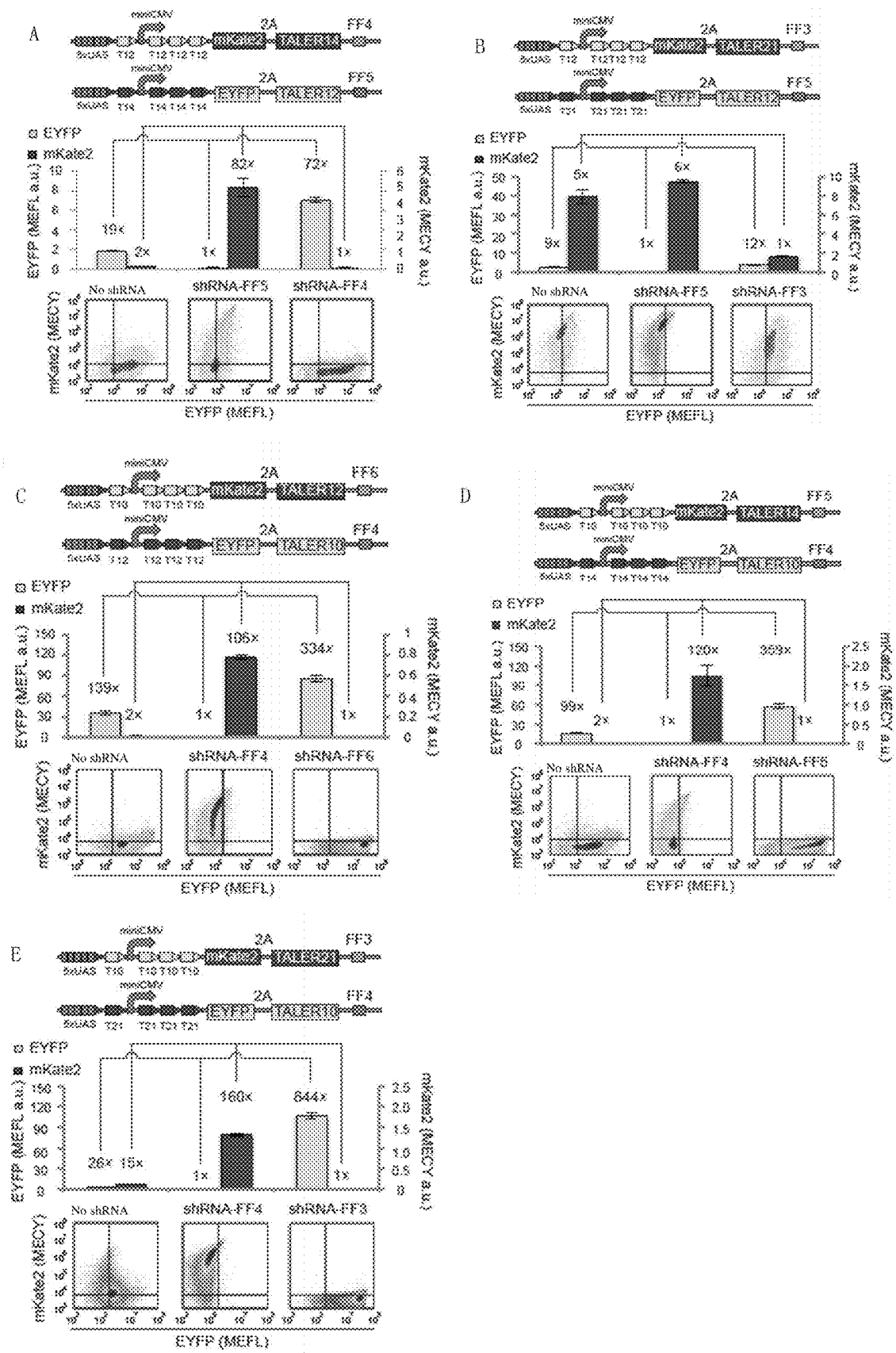

In FIG. 14 and FIG. 15, the bar graph shows the mean±standard deviation of the fluorescence intensities of EYFP or mKate2. The chart below the bar graph shows a representative flow cytometric scattergram detected at 48 h after transfection.

The results indicated that using shRNA as input is sufficient to change the balanced and unbalanced TALER switches to any state.

Example 6. Endogenous microRNA Controls the TALER Switches to Enhance Cell-Type Classification Characteristics The pCAG-Gal4/vp16-2A-TagBFP-2A-B1a plasmid is the pCAG-Gal4/vp16-2A-TagBFP-2A-B1a plasmid in Example 4.

The pT9+T9x3+72-mKate2-2A-TALER10-4xTargetˆFF4 plasmid is the pT9+T9x3+72-mKate2-2A-TALER10-4xTargetˆFF4 plasmid in Example 5.

The pT9+T9x3+72-mKate2-2A-TALER14-4xTargetˆFF4 plasmid is the pT9+T9x3+72-mKate2-2A-TALER14-4xTargetˆFF4 plasmid in Example 5.

The pT14+T14x3+72-EYFP-2A-TALER9-4xTargetˆFF5 plasmid is the pT14+T14x3+72-EYFP-2A-TALER9-4xTargetˆFF5 plasmid in Example 5.

The pSIREN_U6-shRNA-FF5 plasmid is the pSIREN_U6-shRNA-FF5 plasmid in Example 5.

The pT21+T21x3+72-EYFP-2A-TALER12-4xTargetˆFF5 plasmid is the pT21+T21x3+72-EYFP-2A-TALER12-4xTargetˆFF5 plasmid in Example 5.

The pDT7004 plasmid (no specific element, only for balancing in transfection) is as shown in SEQ ID NO: 124.

The pCH150 plasmid is as shown in SEQ ID NO: 125. In the SEQ ID NO: 125, from the 5' end it comprises a pEF1a (promoter) at nucleotides 4781-4861 and a TagBFP encoding gene at nucleotides 6750-7439. The TagBFP is constitutively expressed.

The pCH169 plasmid is as shown in SEQ ID NO: 126. In the SEQ ID NO: 126, from the 5' end it comprises a H1/TO promoter at nucleotides 4608-4703, a shRNA-FF4 encoding gene at nucleotides 4709-4760, a pEF1a (promoter) at nucleotides 4817-5989 and a Tet R encoding gene at nucleotides 6062-6706, and a iRFP encoding gene at nucleotides 6785-7732. In the presence of DOX, the shRNA-FF4 is expressed.

The pCAG-Gal4/vp16 plasmid is as shown in SEQ ID NO: 127. In the SEQ ID NO: 127, from the 5' end it comprises a CAG promoter at nucleotides 4253-5962 and a Gal4/vp16 encoding gene at nucleotides 6019-6702.

The pT14+T14x3+72-EYFP-2A-TALER9-4xTargetˆmiR21 plasmid is as shown in SEQ ID NO: 128. In the SEQ ID NO: 128, from the 5' end it comprises a 5×UAS sequence at nucleotides 4275-4367, a T14 sequence (TALER14 protein target sequence) at nucleotides 4383-4399, a CMVmini promoter at nucleotides 4406-4465, a T14 sequence at nucleotides 4472-4486, a T14 sequence at nucleotides 4487-4503, a T14 sequence at nucleotides 4504-4522, a EYFP encoding gene at nucleotides 4584-5300, a 2A linking peptide encoding gene at nucleotides 5307-5360, a TALER9 protein encoding gene at nucleotides 5370-8915, a miR21 target sequence TargetˆmiR21 at nucleotides 8997-9018, a miR21 target sequence TargetˆmiR21 at nucleotides 9021-9042, a miR21 target sequence TargetˆmiR21 at nucleotides 9056-9077, and a miR21 target sequence TargetˆmiR21 at nucleotides 9080-9101.

The pT9+T9x3+72-mKate2-2A-TALER14-4xTargetˆFF5 plasmid is as shown in SEQ ID NO: 129. In the SEQ ID NO: 129, from the 5' end it comprises a 5×UAS sequence at nucleotides 4275-4367, a T9 sequence (TALER9 protein target sequence) at nucleotides 4383-4403, a CMVmini promoter at nucleotides 4410-4469, a T9 sequence at nucleotides 4476-4496, a T9 sequence at nucleotides 4497-4517, a T9 sequence at nucleotides 4518-4538, a mKate2 encoding gene at nucleotides 4603-5295, a 2A linking peptide encoding gene at nucleotides 5302-5355, a TALER14 protein encoding gene at nucleotides 5365-8502, a shRNA-FF5 target sequence TargetˆFF5 at nucleotides 8593-8614, a shRNA-FF5 target sequence TargetˆFF5 at nucleotides 8615-8636, a shRNA-FF5 target sequence TargetˆFF5 at nucleotides 8637-8658, and a shRNA-FF5 target sequence TargetˆFF5 at nucleotides 8659-8680.

The pT9+T9x3+72-mKate2-2A-TALER14-4xTargetˆmiR18a plasmid is as shown in SEQ ID NO: 130.

In the SEQ ID NO: 130, from the 5' end it comprises a 5×UAS sequence at nucleotides 4275-4367, a T9 sequence (TALER9 protein target sequence) at nucleotides 4383-4403, a CMVmini promoter at nucleotides 4410-4469, a T9 sequence at nucleotides 4476-4496, a T9 sequence at nucleotides 4497-4517, a T9 sequence at nucleotides 4518-4538, a mKate2 encoding gene at nucleotides 4603-5295, a 2A linking peptide encoding gene at nucleotides 5302-5355, a TALER14 protein encoding gene at nucleotides 5365-8502, a miR18a target sequence Target^miR18a at nucleotides 8575-8597, a miR18a target sequence Target^miR18a at nucleotides 8598-8620, a miR18a target sequence Target^miR18a at nucleotides 8621-8643, and a miR18a target sequence Target^miR18a at nucleotides 8644-8666.

The pT9+T9x3+72-mKate2-2A-TALER14-4xTarget^miR19ab plasmid is as shown in SEQ ID NO: 131. In the SEQ ID NO: 130, from the 5' end it comprises a 5×UAS sequence at nucleotides 4275-4367, a T9 sequence (TALER9 protein target sequence) at nucleotides 4383-4403, a CMVmini promoter at nucleotides 4410-4469, a T9 sequence at nucleotides 4476-4496, a T9 sequence at nucleotides 4497-4517, a T9 sequence at nucleotides 4518-4538, a mKate2 encoding gene at nucleotides 4603-5295, a 2A linking peptide encoding gene at nucleotides 5302-5355, a TALER14 protein encoding gene at nucleotides 5365-8502, a miR19ab target sequence Target^miR19ab at nucleotides 8575-8597, a miR19ab target sequence Target^miR19ab at nucleotides 8598-8620, a miR19ab target sequence Target^miR19ab at nucleotides 8621-8643, and a miR19ab target sequence Target^miR19ab at nucleotides 8644-8666.

The pT9+T9x3+72-mKate2-2A-TALER14-4xTarget^miR191 plasmid is as shown in SEQ ID NO: 132. In the SEQ ID NO: 132, from the 5' end it comprises a 5×UAS sequence at nucleotides 4275-4367, a T9 sequence (TALER9 protein target sequence) at nucleotides 4383-4403, a CMVmini promoter at nucleotides 4410-4469, a T9 sequence at nucleotides 4476-4496, a T9 sequence at nucleotides 4497-4517, a T9 sequence at nucleotides 4518-4538, a mKate2 encoding gene at nucleotides 4603-5295, a 2A linking peptide encoding gene at nucleotides 5302-5355, a TALER14 protein encoding gene at nucleotides 5365-8502, a miR191 target sequence Target^miR191 at nucleotides 8575-8597, a miR191 target sequence Target^miR191 at nucleotides 8598-8620, a miR191 target sequence Target^miR191 at nucleotides 8621-8643, and a miR191 target sequence Target^miR191 at nucleotides 8644-8666.

I. Experiment 1

Figure 16:
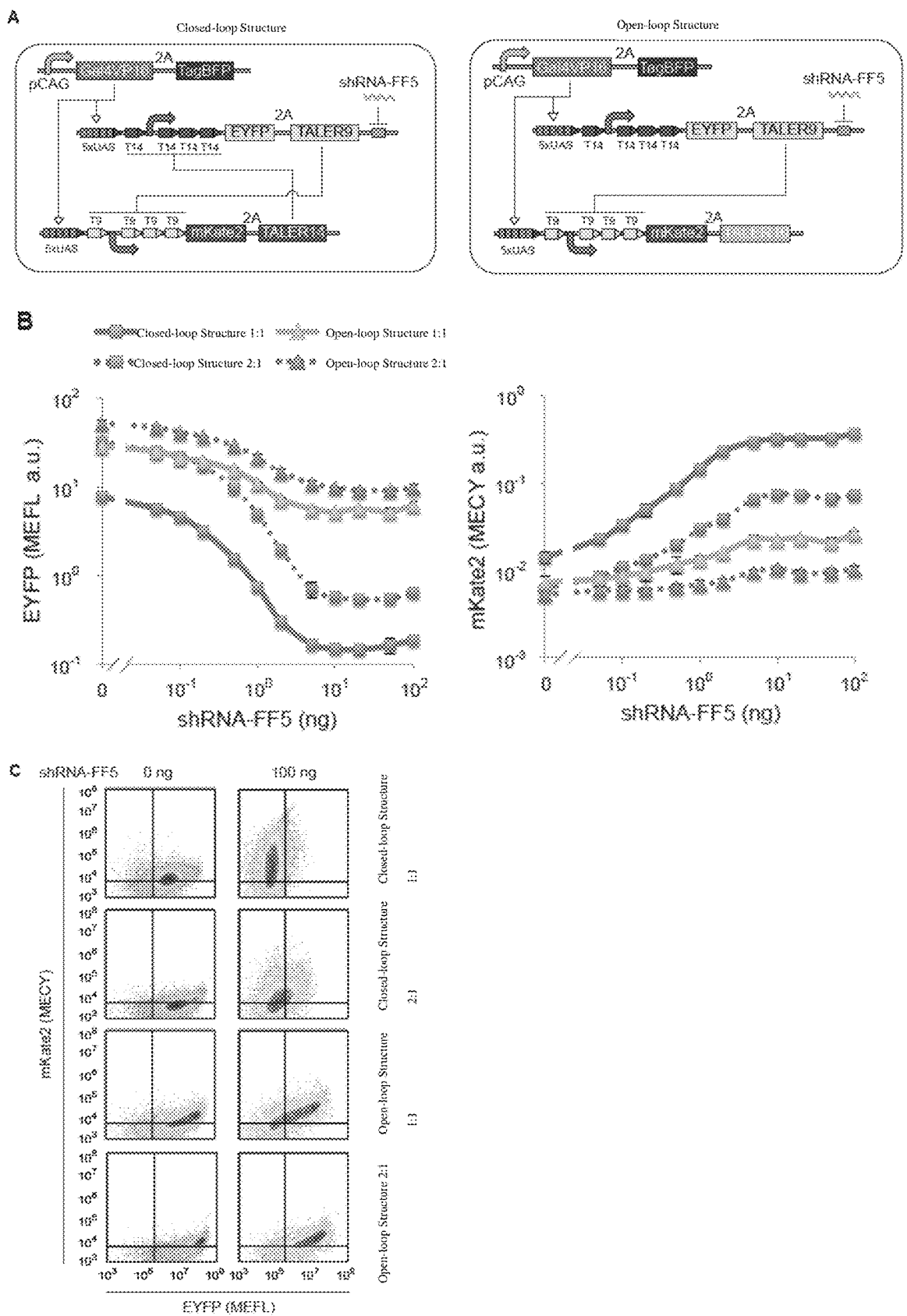
FIG. 16 is the result of step one in Example 6.

Previously, the inventors had demonstrated that HeLa cells can be clearly identified through logical calculation performed by detecting a HeLa-specific microRNA expression profile using synthetic multiple-input logic gene circuits. Such a cell classifier requires extensive optimization to reduce false output, since the signal-to-noise ratio of the over-expressed microRNA detectors of the initial HeLa cells is lower than expectation. In the related studies, it had been found that the mutually repressive structures can serve as powerful switches in the function of cell polarization. The inventors speculated that an unbalanced TALER switches will improve the microRNA detector to have a higher on/off ratio. In this example, the inventors selected a pair of unbalanced TALER proteins (TALER9 protein and TALER14 protein) and constructed a mutually inhibitory closed-loop switch (FIG. 16A) regulated by the synthetic shRNA-FF5 and an open-loop switch (FIG. 16B) in which the TALER9 protein represses the promoter of the TALER10 protein but the TALER10 protein does not inhibit the promoter of the TALER9 protein.

The method of cell transfection with plasmids is as follows: take a 24 well plate; 0.5 mL of HEK293 cell suspension (containing 6×10$^4$ HEK293 cells) is seeded into each well; after 24 hours of culture, replace with fresh DMEM culture medium; then transfect plasmids.

1. (Open-loop structure 1:1) The pCAG-Gal4/vp16-2A-TagBFP-2A-B1a plasmid, pT9+T9x3+72-mKate2-2A-TALER10-4xTarget^FF4 plasmid, pT14+T14x3+72-EYFP-2A-TALER9-4xTarget^FF5 plasmid, pSIREN_U6-shRNA-FF5 plasmid and pDT7004 plasmid were co-transfected into HEK293 cells (each well was transfected with 100 ng pCAG-Gal4/vp16-2A-TagBFP-2A-B1a plasmid, 100 ng pT9+T9x3+72-mKate2-2A-TALER10-4xTarget^FF4 plasmid, 100 ng pT14+T14x3+72-EYFP-2A-TALER9-4xTarget^FF5 plasmid, z ng pSIREN_U6-shRNA-FF5 plasmid and 100-z ng pDT7004 plasmid), z=0, 0.05, 0.1, 0.2, 0.5, 1, 2, 5, 10, 20, 50 or 100. After 48 hours of transfection, flow cytometry analysis was performed and the fluorescence intensities of mKate2, TagBFP and EYFP were detected.

2. (Open-loop structure 2:1) The pCAG-Gal4/vp16-2A-TagBFP-2A-B1a plasmid, pT9+T9x3+72-mKate2-2A-TALER10-4xTarget^FF4 plasmid, pT14+T14x3+72-EYFP-2A-TALER9-4xTarget^FF5 plasmid, pSIREN_U6-shRNA-FF5 plasmid and pDT7004 plasmid were co-transfected into HEK293 cells (each well was transfected with 100 ng pCAG-Gal4/vp16-2A-TagBFP-2A-B1a plasmid, 100 ng pT9+T9x3+72-mKate2-2A-TALER10-4xTarget^FF4 plasmid, 200 ng pT14+T14x3+72-EYFP-2A-TALER9-4xTarget^FF5 plasmid, z ng pSIREN_U6-shRNA-FF5 plasmid and 100-z ng pDT7004 plasmid), z=0, 0.05, 0.1, 0.2, 0.5, 1, 2, 5, 10, 20, 50 or 100. After 48 hours of transfection, flow cytometry analysis was performed and the fluorescence intensities of mKate2, TagBFP and EYFP were detected.

3. (Closed-loop structure 1:1) The pCAG-Gal4/vp16-2A-TagBFP-2A-B1a plasmid, pT9+T9x3+72-mKate2-2A-TALER14-4xTarget^FF4 plasmid, pT14+T14x3+72-EYFP-2A-TALER9-4xTarget^FF5 plasmid, pSIREN_U6-shRNA-FF5 plasmid and pDT7004 plasmid were co-transfected into HEK293 cells (each well was transfected with 100 ng pCAG-Gal4/vp16-2A-TagBFP-2A-B1a plasmid, 100 ng pT9+T9x3+72-mKate2-2A-TALER14-4xTarget^FF4 plasmid, 100 ng pT14+T14x3+72-EYFP-2A-TALER9-4xTarget^FF5 plasmid, z ng pSIREN_U6-shRNA-FF5 plasmid and 100-z ng pDT7004 plasmid), z=0, 0.05, 0.1, 0.2, 0.5, 1, 2, 5, 10, 20, 50 or 100. After 48 hours of transfection, flow cytometry analysis was performed and the fluorescence intensities of mKate2, TagBFP and EYFP were detected.

4. (Closed-loop structure 2:1) The pCAG-Gal4/vp16-2A-TagBFP-2A-B1a plasmid, pT9+T9x3+72-mKate2-2A-TALER14-4xTarget^FF4 plasmid, pT14+T14x3+72-EYFP-2A-TALER9-4xTarget^FF5 plasmid, pSIREN_U6-shRNA-FF5 plasmid and pDT7004 plasmid were co-transfected into HEK293 cells (each well was transfected with 100 ng pCAG-Gal4/vp16-2A-TagBFP-2A-B1a plasmid, 100 ng pT9+T9x3+72-mKate2-2A-TALER14-4xTarget^FF4 plasmid, 200 ng pT14+T14x3+72-EYFP-2A-TALER9-4xTarget^FF5 plasmid, z ng pSIREN_U6-shRNA-FF5 plasmid and 100-z ng pDT7004 plasmid), z=0, 0.05, 0.1, 0.2, 0.5, 1, 2, 5, 10, 20, 50 or 100. After 48 hours of transfection, flow cytometry analysis was performed and the fluorescence intensities of mKate2, TagBFP and EYFP were detected.

The mKate2 fluorescence intensity/TagBFP fluorescence intensity=the corrected mKate2 fluorescence intensity. The EYFP fluorescence intensity/TagBFP fluorescence intensity=the corrected EYFP fluorescence intensity. The corrected mKate2 fluorescence intensity and the corrected EYFP fluorescence intensity were used in FIG. 16.

The fluorescence intensities of EYFP or mKate2 are shown in FIG. 16B (the points from left to right represent the increasing in the added amount of the pSIREN_U6-shRNA-FF5 plasmid), and a representative flow cytometry scattergram detected at 48 hours after transfection is shown in FIG. 16C. In the transfection experiments, when the same amount of the two TALER plasmids were used, about 26-fold of mKate2 induction expression was observed in the closed-loop switch but only about 4-fold of mKate2 induction expression was observed in the open-loop switch, with addition of 100 ng shRNA-FF5. Using a 2:1 ratio of TALER9 and TALER14 plasmids required approximately 8-fold more shRNA to achieve the same level of induced expression of mKate2 compared with using equal quantity of the TALER9 and TALER14 plasmids. The results indicated that the closed-loop TALER switch significantly improves the sensitivity and accuracy of microRNA signal detection, and the sensitivity to microRNA input can be adjusted by changing the ratio of two TALERs.

II. Experiment 2

Next, the inventors attempted to control the TALER switches with endogenous microRNAs. The microRNA expression database indicated that miR18a, miR191 and miR19ab (miR19a plus miR19b) are highly expressed in HEK293 cells and lowly expressed in HeLa cells. HeLa cell specific microRNA is miR21. See FIG. 17B.

1. Preparation of Recombinant Cell Lines

A HeLa cell line (HeLa: TagBFP) expressing the blue fluorescent protein TagBFP was obtained by introducing the pCH150 plasmid into HeLa cells. A HEK293 cell line (HEK293: iRFP_shRNA-FF4) expressing the near-infrared fluorescent protein iRFP and shRNA-FF4 was obtained by introducing the pCH169 plasmid into HEK293 cells. The specific method was as follows:

1 mL of DMEM complete medium containing about $2 \times 10^5$ HEK293-FT cells (293FT Cell Line, Invitrogen™, Cat. No. R700-07) was added to each well in a 12-well plate and cultured for 24 hours. Then, the pCH150 plasmid, the packaging vector pCMV-dR8.2 (Addgene company) and pCMV-VSV-G (Addgene company) were co-transfected using Lipofectamine LTX with Plus reagent. After transfection for 24 hours, the culture supernatant was collected, which is the virus solution containing the TagBFP-expressing lentivirus, referred to as the primary virus solution. 1 mL of the primary virus solution, 1 mL of the medium and 10 μg/mL of the polybrene (Millipore company) were added to each well of a 24-well plate containing about $2 \times 10^5$ HeLa cells per well and cultured for 72 hours. Then, blasticidin (InvivoGen company) at a final concentration of 5 μg/mL was added and cultured for 6 days. And then, the concentration of blasticidin was increased to 10 μg/mL and cultured for 2 days. It was confirmed by flow cytometry that about 95% HeLa: TagBFP cells were TagBFP positive.

1 mL of DMEM complete medium containing about $2 \times 10^5$ HEK293-FT cells was added to each well in a 12-well plate and cultured for 24 hours. Then, the pCH169 plasmid, the packaging vector pCMV-dR8.2 (Addgene company) and pCMV-VSV-G (Addgene company) were co-transfected using Lipofectamine LTX with Plus reagent. After transfection for 24 hours, the culture supernatant was collected, which is the virus solution containing the lentivirus expressing iRFP_shRNA-FF4, referred to as the primary virus solution. 1 mL of the primary virus solution, 1 mL of the medium and 10 μg/mL of the polybrene (Millipore company) were added to each well of a 24-well plate containing about $2 \times 10^5$ HEK293 cells per well and cultured for 72 hours. Then, blasticidin (InvivoGen company) at a final concentration of 5 μg/mL was added and cultured for 6 days. And then, the concentration of blasticidin was increased to 10 μg/mL and cultured for 2 days. It was confirmed by flow cytometry that about 40% HEK293:iRFP_shRNA-FF4 cells were iRFP positive. iRFP-positive HEK293: iRFP_shRNA-FF4 cells were enriched by digesting with trypsin and centrifuging at 300 g for 5 minutes, and resuspended with 1× PBS containing 10% FBS (Invitrogen) and 1% sodium pyruvate (Invitrogen). Cell sorting was conducted using BD AriaII. The HEK293: iRFP_shRNA-FF4 cells were sorted by APC-Cy7 channel with a wavelength of 640 nm red laser and 780/60 filter. The first about 10% of the iRFP positive HEK293:iRFP_shRNA-FF4 cells were collected in a 6 well-plate using DMEM complete medium, and cultured in a 37° C. incubator at a humidity of 100% and a carbon dioxide concentration of 5%. After culture, 98% of HEK293: iRFP_shRNA-FF4 cells were iRFP positive, as detected by flow cytometry.

Figure 17:
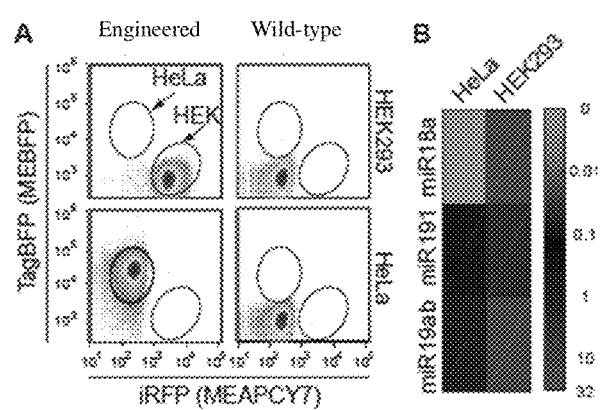
FIG. 17 to FIG. 20 are the results of step two in Example 6.

The flow cytometry scattergrams of HeLa cells (also known as wild-type cells) and HeLa: TagBFP (also known as engineered cells) are shown in FIG. 17A and ellipses represent HEK293: iRFP_shRNA-FF4 and HeLa: TagBFP regions. The flow cytometry scattergrams of HEK293 cells (also known as wild-type cells) and HEK293:iRFP_shRNA-FF4 (also known as engineered cells) are shown in FIG. 17A and ellipses represent HEK293: iRFP_shRNA-FF4 and HeLa: TagBFP regions. In the iRFP/TagBFP scattergram, HEK293:iRFP_shRNA-FF4 cells were significantly different from HeLa:TagBFP cells.

2. HeLa: TagBFP cells and HEK293:iRFP_shRNA-FF4 cells were mixed to obtain a mixed cell population. The pCAG-Gal4/vp16 plasmid, pT14+T14x3+72-EYFP-2A-TALER9-4xTarget^miR-21 plasmid, and pT9+T9x3+72-mKate2-2A-TALER14-4xTarget^FF4 plasmid were co-transfected into the mixed cell population (each well was transfected with 100 ng pCAG-Gal4/vp16 plasmid, x ng pT14+T14x3+72-EYFP-2A-TALER9-4xTarget^miR-21 plasmid, and y ng pT9+T9x3+72-mKate2-2A-TALER14-4xTarget^FF4 plasmid), and in the meantime of transfection, DOX was added to the cell culture system to a concentration of DOX at 1000 ng/mL. After 48 hours of transfection, flow cytometry analysis was performed and the fluorescence intensities of mKate2, TagBFP, iRFP and EYFP were detected. (x:y)=(100:200), (100:150), (100:100), (150, 100) or (200, 100). The method of cell transfection with plasmids is as follows: take a 24 well-plate; 0.5 mL of mixed cell suspension (containing $6 \times 10^4$ mixed cells) is seeded into each well; after 24 hours of culture, replace with fresh DMEM culture medium; then transfect plasmids.

Flow cytometry analysis graph indicated that the number of HeLa: TagBFP cells and HEK293: iRFP_shRNA-FF4 cells were basically consistent at the time of analysis.

Figure 18:
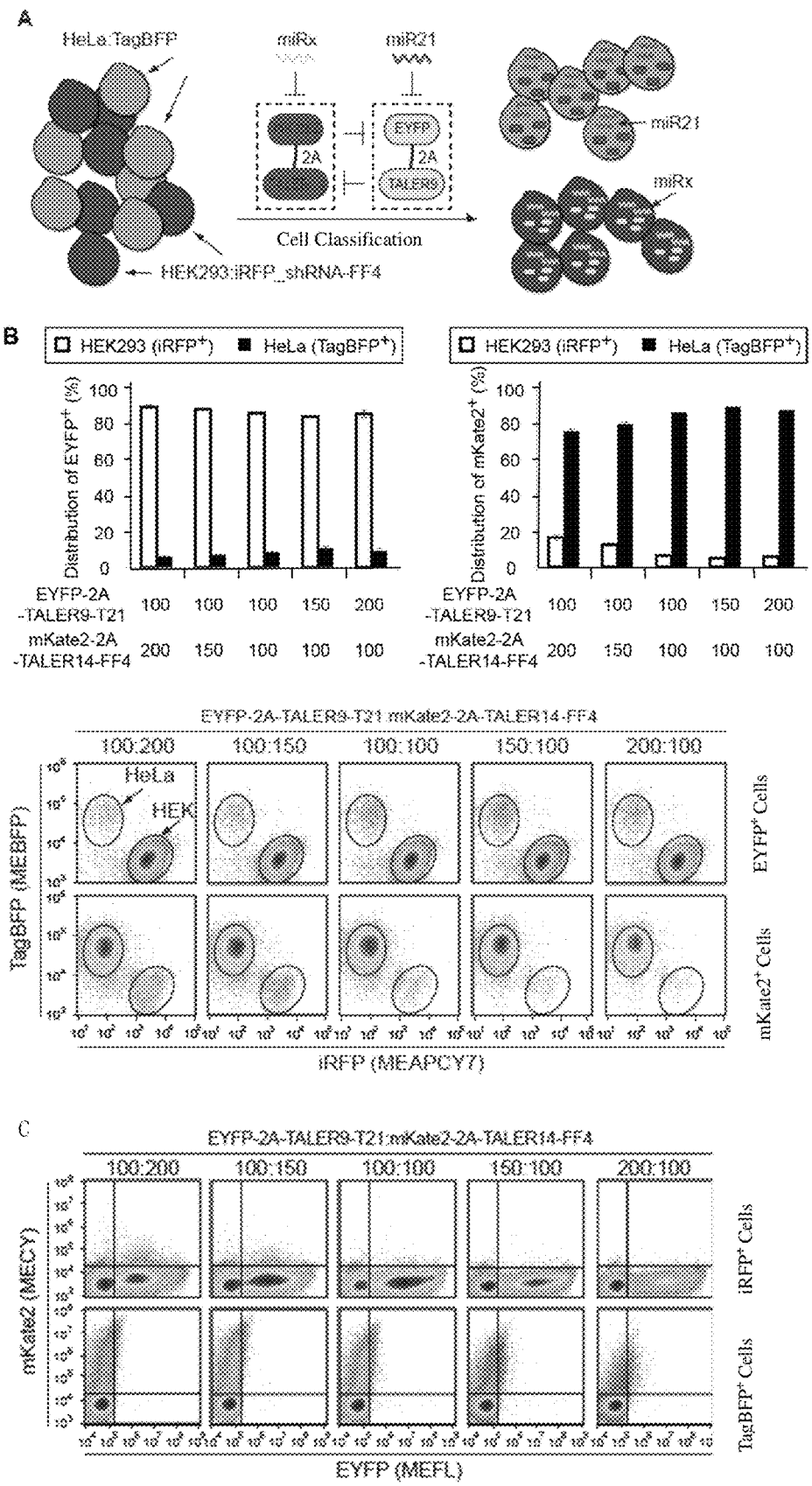

The schematic diagram of principle is shown in FIG. 18A. The results are shown in FIG. 18B. The bar graph shows the proportion of HeLa: TagBFP cells and HEK293: iRFP_shRNA-FF4 cells in the EYFP$^+$ or mKate2$^+$ cell population. All data bars represent the mean±SD of experiment results of three independent replicates. The upper row of the iRFP-TagBFP flow cytometer scattergram shows the distribution of EYFP$^+$ cell population, the lower row shows the distribution of mKate2$^+$ cell population, and the ellipses represent the engineered HEK293 or HeLa cell population. FIG. 18C shows a representative EYFP-mKate2 flow cell scattergram.

In all tested ratios, the TALER switches generated high EYFP expression in HEK293: iRFP_shRNA-FF4 cells, but had substantially no mKate2 expression. In all tested ratios, the TALER switches generated high mKate2 expression in HeLa: TagBFP cells, but had almost no EYFP expression. When the switches at a ratio of 1:1 were transfected into the mixed cell population, about 9% of HeLa: TagBFP cells were false EYFP-positive, and about 7% of HEK293: iRFP_shRNA-FF4 cells were false mKate2-positive, which is the most accurate in all the tested ratios.

3. The TALER switches can be controlled by endogenous microRNAs

HeLa: TagBFP cells and HEK293:iRFP_shRNA-FF4 cells were mixed to obtain a mixed cell population. The pCAG-Gal4/vp16 plasmid, pT14+T14x3+72-EYFP-2A-TALER9-4xTarget^miR-21 plasmid, and pT9+T9x3+72-mKate2-2A-TALER14-4xTarget^miR18a plasmid were co-transfected into the mixed cell population (each well was transfected with 100 ng pCAG-Gal4/vp16 plasmid, 100 ng pT14+T14x3+72-EYFP-2A-TALER9-4xTarget^miR-21 plasmid, and 100 ng pT9+T9x3+72-mKate2-2A-TALER14-4xTarget^miR18a plasmid), and in the meantime of transfection, DOX was added to the cell culture system to a concentration of DOX at 1000 ng/mL. After 48 hours of transfection, flow cytometry analysis was performed and the fluorescence intensities of mKate2, TagBFP, iRFP and EYFP were detected. The method of cell transfection with plasmids is as follows: take a 24-well plate; 0.5 mL of mixed cell suspension (containing $6 \times 10^4$ mixed cells) is seeded into each well; after 24 hours of culture, replace with fresh DMEM culture medium; then transfect plasmids.

The above procedure was carried out using the pT9+T9x3+72-mKate2-2A-TALER14-4xTarget^miR19ab plasmid in place of the pT9+T9x3+72-mKate2-2A-TALER14-4xTarget^miR18a plasmid.

The above procedure was carried out using the pT9+T9x3+72-mKate2-2A-TALER14-4xTarget^miR191 plasmid in place of the pT9+T9x3+72-mKate2-2A-TALER14-4xTarget^miR18a plasmid.

Flow cytometry analysis graph indicated that the number of HeLa: TagBFP cells and HEK293: iRFP_shRNA-FF4 cells were basically consistent at the time of analysis.

Figure 19:
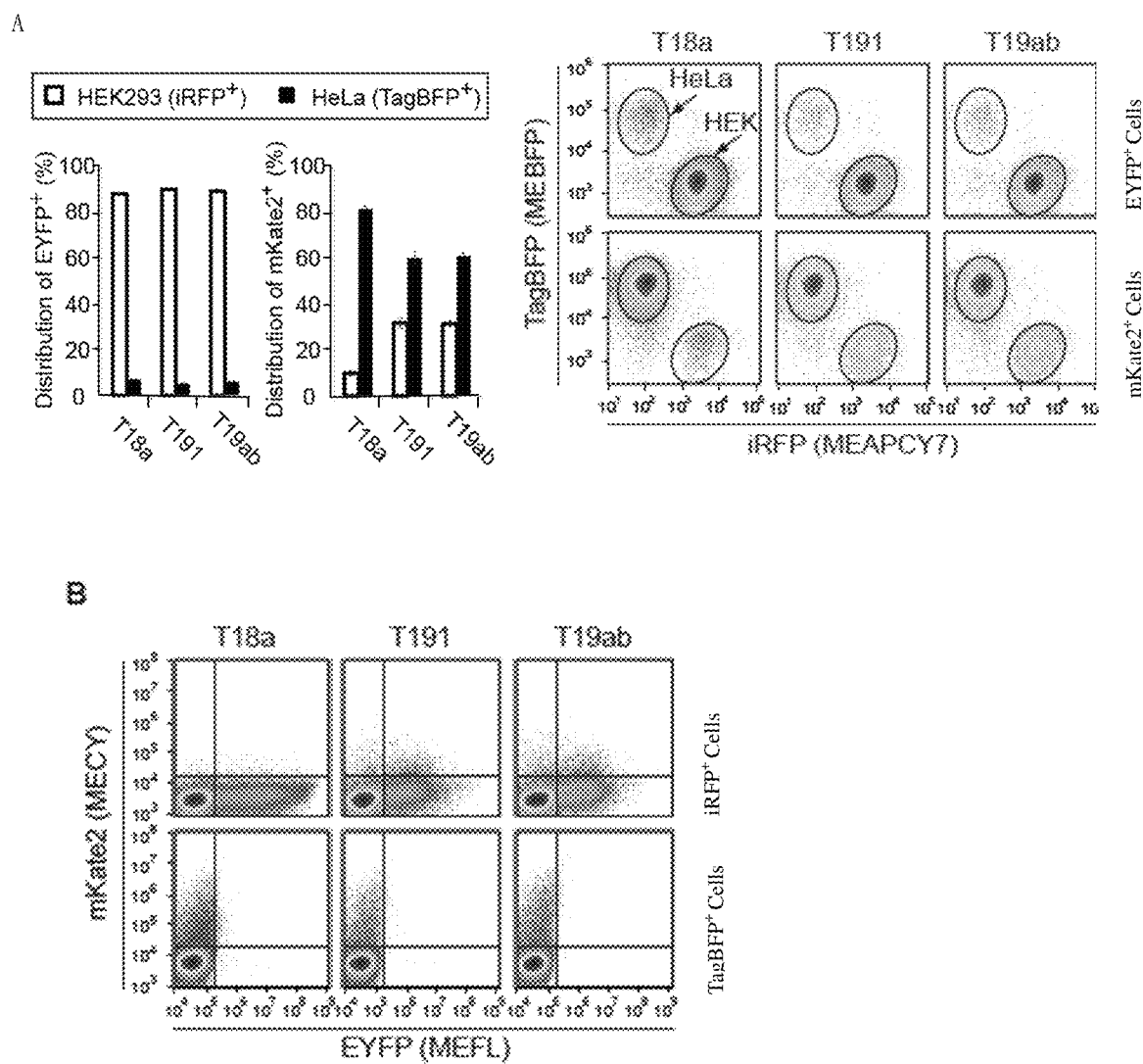

The results are shown in FIG. 19A. The bar graph shows the proportion of HeLa: TagBFP cells and HEK293: iRFP_shRNA-FF4 cells in the EYFP+ or mKate2+ cell population. All data bars represent the mean±SD of experiment results of three independent replicates. The upper row of the iRFP-TagBFP flow cytometer scattergram shows the distribution of EYFP+ cell population, the lower row shows the distribution of mKate2+ cell population, and the ellipses represent the engineered HEK293 or HeLa cell population. FIG. 19B shows a representative EYFP-mKate2 flow cell scattergram.

The results indicated that the HEK293-specific miR18a and the HeLa-specific miR21 serve as the best input of endogenous microRNA classifier signal. This also indicated that the TALER switches can be controlled by endogenous microRNAs.

4. Selective effects of HEK293-specific microRNAs in the mixed cell population

Figure 20:
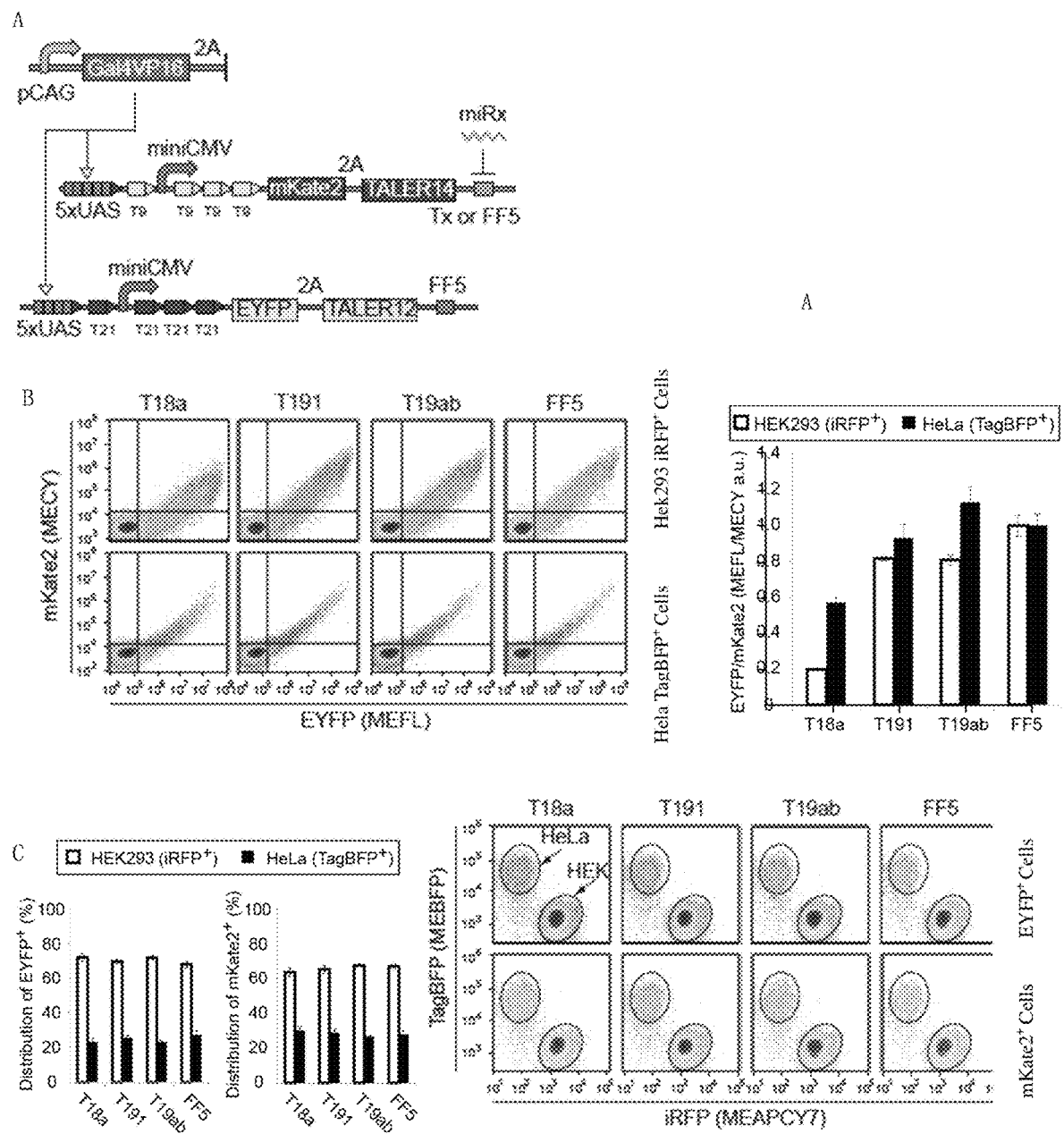

The gene circuit is shown in FIG. 20A. miRx represents miR18a, miR191 or miR19ab, Tx represents a quadruple repeat sequence of the fully complementary target site of miR18a, miR191, and miR19ab, and FF5 represents a quadruple repeat sequence of the fully complementary target site of shRNA-FF5.

HeLa: TagBFP cells and HEK293:iRFP_shRNA-FF4 cells were mixed to obtain a mixed cell population. The pCAG-Gal4/vp16 plasmid, pT21+T21x3+72-EYFP-2A-TALER12-4xTarget^FF5 plasmid, and pT9+T9x3+72-mKate2-2A-TALER14-4xTarget^FF5 plasmid were co-transfected into the mixed cell population (each well was transfected with 100 ng pCAG-Gal4/vp16 plasmid, 100 ng pT21+T21x3+72-EYFP-2A-TALER12-4xTarget^FF5 plasmid, and 100 ng pT9+T9x3+72-mKate2-2A-TALER14-4xTarget^FF5 plasmid), and in the meantime of transfection, DOX was added to the cell culture system to a concentration of DOX at 1000 ng/mL. After 48 hours of transfection, flow cytometry analysis was performed and the fluorescence intensities of mKate2, TagBFP, iRFP and EYFP were detected. The method of cell transfection with plasmids is as follows: take a 24-well plate; 0.5 mL of mixed cell suspension (containing $6 \times 10^4$ mixed cells) is seeded into each well; after 24 hours of culture, replace with fresh DMEM culture medium; then transfect plasmids.

The above procedure was carried out using the pT9+T9x3+72-mKate2-2A-TALER14-4xTarget^miR18a plasmid in place of the pT9+T9x3+72-mKate2-2A-TALER14-4xTarget^FF5 plasmid.

The above procedure was carried out using the pT9+T9x3+72-mKate2-2A-TALER14-4xTarget^miR19ab plasmid in place of the pT9+T9x3+72-mKate2-2A-TALER14-4xTarget^FF5 plasmid.

The above procedure was carried out using the pT9+T9x3+72-mKate2-2A-TALER14-4xTarget^miR191 plasmid in place of the pT9+T9x3+72-mKate2-2A-TALER14-4xTarget^FF5 plasmid.

Flow cytometry analysis graph indicated that the number of HeLa: TagBFP cells and HEK293: iRFP_shRNA-FF4 cells were basically consistent at the time of analysis.

FIG. 20B: The left graph shows the representative EYFP-mKate2 flow cytometry scattergrams of HEK293: iRFP_shRNA-FF4 cells and HeLa: TagBFP cells; the right graph shows the microRNA knockout efficiency in the corresponding cells, and all bars represent the ratio of the mKate2 fluorescence mean value to the EYFP fluorescence mean value obtained from three independent replicate experiments. FIG. 20C: The bar graph shows the proportion of engineered HEK293 and HeLa cells in the EYFP+ or mKate2+ cell population, with all representing the mean±standard deviation from three independent replicate experiments; the upper row of the iRFP-TagBFP flow cell scattergram shows the distribution of EYFP+ cells, the lower row shows the distribution of mKate2+ cells, and the ellipses represent the engineered HEK293 or HeLa region.

Fluorescent reporter gene assay in the mixed cell population indicated that miR18a had a significant RNAi knockout effect whereas miR191 and miR19ab did not, and the TALER switches, without the mutually repressive open-loop structures, also cannot achieve cell sorting effectively.

Figure 21:
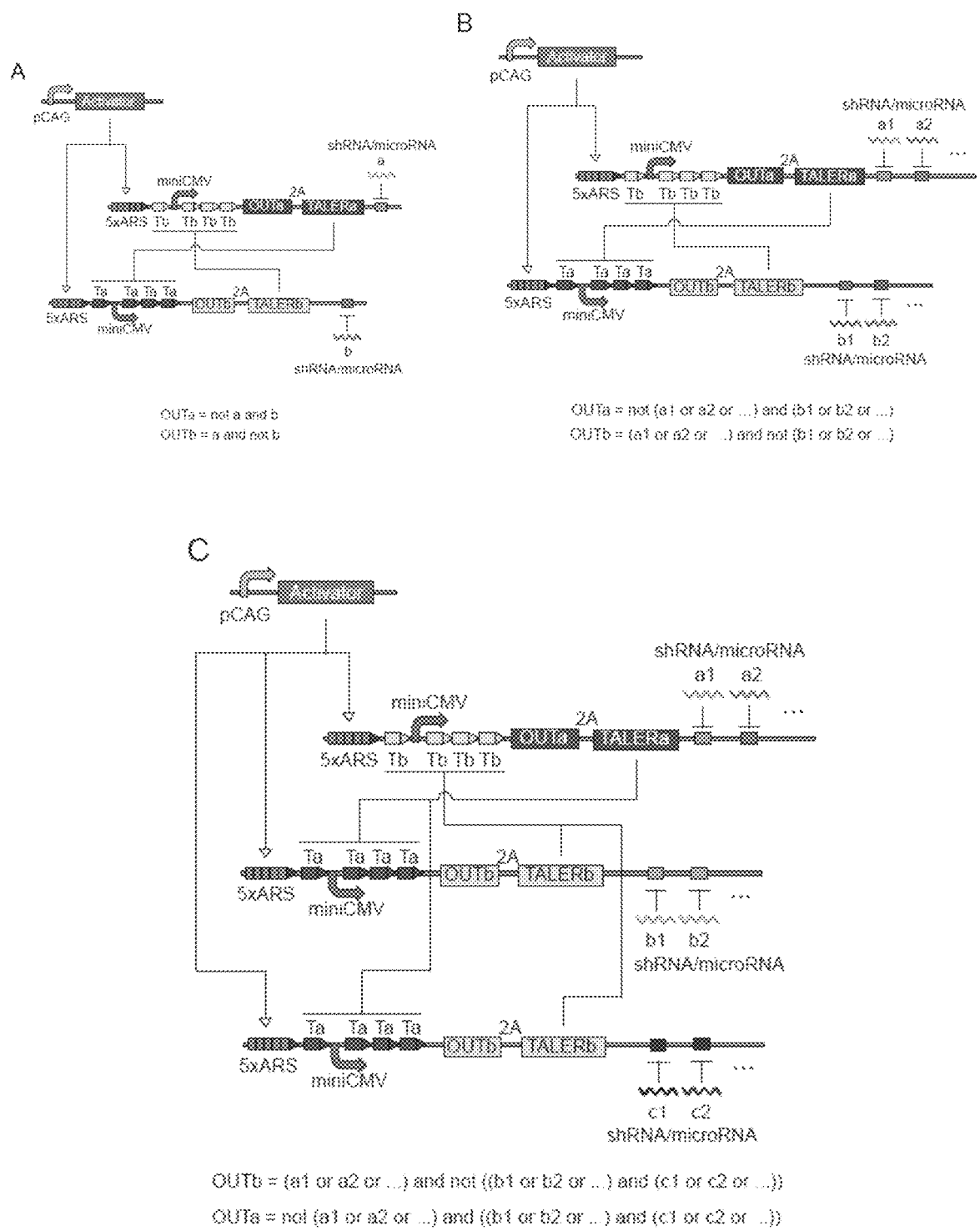
FIG. 21 shows a further extended gene circuit.

Further extended gene circuits are shown in FIG. 21 (schematic diagram of the combinatorial logical extension of the TALER switches). TALERa and TALERb represent the TALER genes; 2A represents the self-cleaving amino acid sequence; Ta and Tb represent the binding sites of TALERa and TALERb; Activator represents the transcriptional activator; 5×UAS represents the transcriptional activation response site; miniCMV represents the minimal CMV promoter; pCAG represents the constitutive promoter; OUTa and OUTb represent two different outputs. (A) The basic design of the TALER switches. shRNA or microRNA a,b serves as an input. The blow shows the corresponding logical formula. (B) a TALER switch that makes input extensions of multiple shRNAs or microRNAs by increasing the siRNA or microRNA target sites. shRNA or microRNA a1, a2, and b1, b2, and the like serve as an input. The blow shows the corresponding logical expression formula. (C) a TALER switch that makes input extensions of multiple shRNAs or microRNAs by increasing the paralleled output circuits.

INDUSTRIAL APPLICABILITY

The core idea of synthetic biology is the use of standardized, interchangeable genetic elements to rationally design and predict, as well as achieve synthetic gene circuits. However, the existing gene element libraries lack clear functional descriptions, rapid time response and orthogonal regulatory transcriptional repressors. This limits the construction of complex gene circuits in mammalian cells. In the present invention, the inventors constructed a TALE (transcription activator-like effector) repressor protein library comprising 26 orthogonal, reversible TALE repressors and newly designed synthetic promoters that can be combined therewith. The two through combination form a steric hindrance for the transcriptional initiation critical factors, thereby inhibiting transcription. The inventors had shown that the cascade and switching effects of the TALE transcriptional repressor (TALER) can be accurately predicted using the input/output transfer function, and also shown that the TALER switches have better accuracy on the microRNA-based cancer cell classification using feedback regulation. The orthogonal, reversible TALER protein library constructed by the inventors is a valuable tool for modular synthesis of gene circuits and programmable mammalian cell manipulation, and is conducive to explain design principles of the combinatory regulation at the transcriptional level and the microRNA-mediated post-transcriptional level.

SEQUENCE LISTING (160 sequences)

SEQ ID NO: 1 - DNA, 7657 bp, Artificial Sequence
  plasmid construct
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgaattcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagggcccggcgcgcctaaggtacccccgggtctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgccatgcat

SEQ ID NO: 2 - DNA, 7657 bp, Artificial Sequence
  plasmid construct
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgaattcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagggcccggcgcgcctaaggtacccccgggtctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgccatgcat

SEQ ID NO: 3 - DNA, 7657 bp, Artificial Sequence; identical to SEQ ID NO: 2
  plasmid construct

SEQ ID NO: 4 - DNA, 8082 bp, Artificial Sequence
  plasmid construct
ccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagggcccggcgcgcctaaggtacccccgggtctagagatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgccatgcattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgaattcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgccc

SEQ ID NO: 5 - DNA, 8388 bp, Artificial Sequence
  plasmid construct
ccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagggcccggcgcgcctaaggtacccccgggtctagagatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgccatgcattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgaattcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgccc

SEQ ID NO: 6 - DNA, 8388 bp, Artificial Sequence; identical to SEQ ID NO: 5
  plasmid construct

SEQ ID NO: 7 - DNA, 8286 bp, Artificial Sequence
  plasmid construct
ccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgccatgcattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgaattcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagggcccggcgcgcctaaggtacccccgggtctagagatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtat

SEQ ID NO: 8 - DNA, 8082 bp, Artificial Sequence
  plasmid construct
ccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgccatgcattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgaattcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagggcccggcgcgcctaaggtacccccgggtctagagatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcga

SEQ ID NO: 9 - DNA, 8082 bp, Artificial Sequence; identical to SEQ ID NO: 8
  plasmid construct

SEQ ID NO: 10 - DNA, 7980 bp, Artificial Sequence
  plasmid construct
atcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgccatgcattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgaattcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagggcccggcgcgcctaaggtacccccgggtctagagatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatcc

SEQ ID NO: 11 - DNA, 8035 bp, Artificial Sequence
  plasmid construct
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgaattcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgacgtggacctgagaacactgggatattctcagcagcagcaggagaagatcaagcccaaggtgagatccacagtggcccagcaccacgaagccctggtgggacacggatttacacacgcccacattgtggccctgtctcagcaccctgccgccctgggaacagtggccgtgaaatatcaggatatgattgccgccctgcctgaggccacacacgaagccattgtgggagtgggaaaacagtggtctggagccagagccctggaagccctgctgacagtggccggagaactgagaggacctcctctgcagctggatacaggacagctgctgaagattgccaaaaggggcggagtgaccgcggtggaagccgtgcacgcctggagaaatgccctgacaggagcccctctgaacctgacccccgaacaggtggtggccattgccagccacgacggcggcaagcaggccctggaaaccgtgcagagactgctgcccgtgctgtgccaggcccatggcctgacacctgaacaggtggtggctatcgcctctcacgacggaggaaaacaggctctggaaacagtgcagcggctgctgcctgtgctgtgtcaggctcacggcttgactccagaacaggtggtggctattgcttccaacggcggggggaaacaggccctggaaactgtgcagcgcctgctgccagtgctgtgccaggctcacggactgacccccgaacaggtggtggccattgccagcaacaagggcggcaagcaggccctggaaaccgtgcagagactgctgcccgtgctgtgccaggcccatggcctgacacctgaacaggtggtggctatcgcctctaatatcggaggaaaacaggctctggaaacagtgcagcggctgctgcctgtgctgtgtcaggctcacggcttgactccagaacaggtggtggctattgcttcccacgacggggggaaacaggccctggaaactgtgcagcgcctgctgccagtgctgtgccaggctcacgggctgacccccgaacaggtggtggccattgccagccacgacggcggcaagcaggccctggaaaccgtgcagagactgctgcccgtgctgtgccaggcccatggcctgacacctgaacaggtggtggctatcgcctctaatatcggaggaaaacaggctctggaaacagtgcagcggctgctgcctgtgctgtgtcaggctcacggcttgactccagaacaggtggtggctattgcttccaacggcggggggaaacaggccctggaaactgtgcagcgcctgctgccagtgctgtgccaggctcacggtttgacccccgaacaggtggtggccattgccagcaacggcggcggcaagcaggccctggaaaccgtgcagagactgctgcccgtgctgtgccaggcccatggcctgacacctgaacaggtggtggctatcgcctctcacgacggaggaaaacaggctctggaaacagtgcagcggctgctgcctgtgctgtgtcaggctcacggcttgactccagaacaggtggtggctattgcttccaatattggggggaaacaggccctggaaactgtgcagcgcctgctgccagtgctgtgccaggctcacggcctcactcccgaacaggtggtggccattgccagcaacggcggcggcaagcaggccctggaaaccgtgcagagactgctgcccgtgctgtgccaggcccatggcctgacacctgaacaggtggtggctatcgcctctcacgacggaggaaaacaggctctggaaacagtgcagcggctgctgcctgtgctgtgtcaggctcacggcttgactccagaacaggtggtggctattgcttccaatattggggggaaacaggccctggaaactgtgcagcgcctgctgccagtgctgtgccaggctcacggactgacccccgaacaggtggtggccattgccagcaacaagggcggcaagcaggccctggaaaccgtgcagagactgctgcccgtgctgtgccaggcccatggcctgacacctgaacaggtggtggctatcgcctctcacgacggaggaaaacaggctctggaaacagtgcagcggctgctgcctgtgctgtgtcaggctcacggcttgactccagaacaggtggtggctattgcttcccacgacggggggaaacaggccctggaaactgtgcagcgcctgctgccagtgctgtgccaggctcacgggctgacccccgaacaggtggtggccattgccagcaacaagggcggcaagcaggccctggaaaccgtgcagagactgctgcccgtgctgtgccaggcccatggcctgacacctgaacaggtggtggctatcgcctctaacggcggaggaaaacaggctctggaaacagtgcagcggctgctgcctgtgctgtgtcaggctcacggcttgactccagaacaggtggtggctattgcttcccacgacggggggaaacaggccctggaaactgtgcagcgcctgctgccagtgctgtgccaggctcacggtttgacccccgaacaggtggtggccattgccagcaacggcggcggcaagcaggccctggaaaccgtgcagagactgctgcccgtgctgtgccaggcccatggcctgacacctgaacaggtggtggctatcgcctctaatatcggaggaaaacaggctctggaaacagtgcagcggctgctgcctgtgctgtgtcaggctcacggcttgactccacagcaggtcgtggcaattgctagcaacggcggcggacggcccgccctggagagcattgtggcccagctgtctagacctgatcctgccctggccgccctgacaaatgatcacctggtggccctggcctgtctgggaggcagacctgccctggatgccgtgaaaaaaggactgcctcacgcccctgccctgatcaagagaacaaatagaagaatccccgagcggacctctcacagagtggccgatcacgcccaggtggtgagagtgctgggattttttcagtgtcactctcaccctgcccaggcctttgatgatgccatgacacagtttggcatgagcagacacggactgctgcagctgtttagaagagtgggagtgacagaactggaggccagatccggaaccctgcctcctgcctctcagagatgggataggattctgcagggatcccagccccaagaagaagagaaaggtggaggccagcggtggcggctcaaagcttggtggcggctcaactagttaagggcccggcgcgcctaaggtacccccgggtctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgccatgcat

SEQ ID NO: 12 - DNA, 8035 bp, Artificial Sequence; identical to SEQ ID NO: 11
  plasmid construct

SEQ ID NO: 13 - DNA, 8035 bp, Artificial sequence
  plasmid construct
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgaattcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgacgtggacctgagaacactgggatattctcagcagcagcaggagaagatcaagcccaaggtgagatccacagtggcccagcaccacgaagccctggtgggacacggatttacacacgcccacattgtggccctgtctcagcaccctgccgccctgggaacagtggccgtgaaatatcaggatatgattgccgccctgcctgaggccacacacgaagccattgtgggagtgggaaaacagtggtctggagccagagccctggaagccctgctgacagtggccggagaactgagaggacctcctctgcagctggatacaggacagctgctgaagattgccaaaaggggcggagtgaccgcggtggaagccgtgcacgcctggagaaatgccctgacaggagcccctctgaacctgacccccgaacaggtggtggccattgccagcaacatcggcggcaagcaggccctggaaaccgtgcagagactgctgcccgtgctgtgccaggcccatggcctgacacctgaacaggtggtggctatcgcctctaacggcggaggaaaacaggctctggaaacagtgcagcggctgctgcctgtgctgtgtcaggctcacggcttgactccagaacaggtggtggctattgcttccaacggcggggggaaacaggccctggaaactgtgcagcgcctgctgccagtgctgtgccaggctcacggactgacccccgaacaggtggtggccattgccagcaacatcggcggcaagcaggccctggaaaccgtgcagagactgctgcccgtgctgtgccaggcccatggcctgacacctgaacaggtggtggctatcgcctctaacggcggaggaaaacaggctctggaaacagtgcagcggctgctgcctgtgctgtgtcaggctcacggcttgactccagaacaggtggtggctattgcttccaacggcggggggaaacaggccctggaaactgtgcagcgcctgctgccagtgctgtgccaggctcacgggctgacccccgaacaggtggtggccattgccagcaacaagggcggcaagcaggccctggaaaccgtgcagagactgctgcccgtgctgtgccaggcccatggcctgacacctgaacaggtggtggctatcgcctctaacaagggaggaaaacaggctctggaaacagtgcagcggctgctgcctgtgctgtgtcaggctcacggcttgactccagaacaggtggtggctattgcttcccacgacggggggaaacaggccctggaaactgtgcagcgcctgctgccagtgctgtgccaggctcacggtttgacccccgaacaggtggtggccattgccagccacgacggcggcaagcaggccctggaaaccgtgcagagactgctgcccgtgctgtgccaggcccatggcctgacacctgaacaggtggtggctatcgcctctaacggcggaggaaaacaggctctggaaacagtgcagcggctgctgcctgtgctgtgtcaggctcacggcttgactccagaacaggtggtggctattgcttccaacggcggggggaaacaggccctggaaactgtgcagcgcctgctgccagtgctgtgccaggctcacggcctcactcccgaacaggtggtggccattgccagcaacatcggcggcaagcaggccctggaaaccgtgcagagactgctgcccgtgctgtgccaggcccatggcctgacacctgaacaggtggtggctatcgcctctaatatcggaggaaaacaggctctggaaacagtgcagcggctgctgcctgtgctgtgtcaggctcacggcttgactccagaacaggtggtggctattgcttcccacgacggggggaaacaggccctggaaactgtgcagcgcctgctgccagtgctgtgccaggctcacggactgacccccgaacaggtggtggccattgccagccacgacggcggcaagcaggccctggaaaccgtgcagagactgctgcccgtgctgtgccaggcccatggcctgacacctgaacaggtggtggctatcgcctctaatatcggaggaaaacaggctctggaaacagtgcagcggctgctgcctgtgctgtgtcaggctcacggcttgactccagaacaggtggtggctattgcttccaacggcggggggaaacaggccctggaaactgtgcagcgcctgctgccagtgctgtgccaggctcacgggctgacccccgaacaggtggtggccattgccagcaacatcggcggcaagcaggccctggaaaccgtgcagagactgctgcccgtgctgtgccaggcccatggcctgacacctgaacaggtggtggctatcgcctctcacgacggaggaaaacaggctctggaaacagtgcagcggctgctgcctgtgctgtgtcaggctcacggcttgactccagaacaggtggtggctattgcttccaacggcggggggaaacaggccctggaaactgtgcagcgcctgctgccagtgctgtgccaggctcacggtttgacccccgaacaggtggtggccattgccagccacgacggcggcaagcaggccctggaaaccgtgcagagactgctgcccgtgctgtgccaggcccatggcctgacacctgaacaggtggtggctatcgcctctaacggcggaggaaaacaggctctggaaacagtgcagcggctgctgcctgtgctgtgtcaggctcacggcttgactccacagcaggtcgtggcaattgctagcaacggcggcggacggcccgccctggagagcattgtggcccagctgtctagacctgatcctgccctggccgccctgacaaatgatcacctggtggccctggcctgtctgggaggcagacctgccctggatgccgtgaaaaaaggactgcctcacgcccctgccctgatcaagagaacaaatagaagaatccccgagcggacctctcacagagtggccgatcacgcccaggtggtgagagtgctgggattttttcagtgtcactctcaccctgcccaggcctttgatgatgccatgacacagtttggcatgagcagacacggactgctgcagctgtttagaagagtgggagtgacagaactggaggccagatccggaaccctgcctcctgcctctcagagatgggataggattctgcagggatcccagccccaagaagaagagaaaggtggaggccagcggtggcggctcaaagcttggtggcggctcaactagttaagggcccggcgcgcctaaggtacccccgggtctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgccatgcat

SEQ ID NO: 14 - DNA, 8035 bp, Artificial Sequence
  plasmid construct
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgaattcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgacgtggacctgagaacactgggatattctcagcagcagcaggagaagatcaagcccaaggtgagatccacagtggcccagcaccacgaagccctggtgggacacggatttacacacgcccacattgtggccctgtctcagcaccctgccgccctgggaacagtggccgtgaaatatcaggatatgattgccgccctgcctgaggccacacacgaagccattgtgggagtgggaaaacagtggtctggagccagagccctggaagccctgctgacagtggccggagaactgagaggacctcctctgcagctggatacaggacagctgctgaagattgccaaaaggggcggagtgaccgcggtggaagccgtgcacgcctggagaaatgccctgacaggagcccctctgaacctgacccccgaacaggtggtggccattgccagccacgacggcggcaagcaggccctggaaaccgtgcagagactgctgcccgtgctgtgccaggcccatggcctgacacctgaacaggtggtggctatcgcctctcacgacggaggaaaacaggctctggaaacagtgcagcggctgctgcctgtgctgtgtcaggctcacggcttgactccagaacaggtggtggctattgcttccaatattggggggaaacaggccctggaaactgtgcagcgcctgctgccagtgctgtgccaggctcacggactgacccccgaacaggtggtggccattgccagcaacggcggcggcaagcaggccctggaaaccgtgcagagactgctgcccgtgctgtgccaggcccatggcctgacacctgaacaggtggtggctatcgcctctaacaagggaggaaaacaggctctggaaacagtgcagcggctgctgcctgtgctgtgtcaggctcacggcttgactccagaacaggtggtggctattgcttccaacggcggggggaaacaggccctggaaactgtgcagcgcctgctgccagtgctgtgccaggctcacgggctgacccccgaacaggtggtggccattgccagcaacatcggcggcaagcaggccctggaaaccgtgcagagactgctgcccgtgctgtgccaggcccatggcctgacacctgaacaggtggtggctatcgcctctaatatcggaggaaaacaggctctggaaacagtgcagcggctgctgcctgtgctgtgtcaggctcacggcttgactccagaacaggtggtggctattgcttccaatattggggggaaacaggccctggaaactgtgcagcgcctgctgccagtgctgtgccaggctcacggtttgacccccgaacaggtggtggccattgccagcaacatcggcggcaagcaggccctggaaaccgtgcagagactgctgcccgtgctgtgccaggcccatggcctgacacctgaacaggtggtggctatcgcctctcacgacggaggaaaacaggctctggaaacagtgcagcggctgctgcctgtgctgtgtcaggctcacggcttgactccagaacaggtggtggctattgcttccaatattggggggaaacaggccctggaaactgtgcagcgcctgctgccagtgctgtgccaggctcacggcctcactcccgaacaggtggtggccattgccagcaacggcggcggcaagcaggccctggaaaccgtgcagagactgctgcccgtgctgtgccaggcccatggcctgacacctgaacaggtggtggctatcgcctctaacggcggaggaaaacaggctctggaaacagtgcagcggctgctgcctgtgctgtgtcaggctcacggcttgactccagaacaggtggtggctattgcttccaacggcggggggaaacaggccctggaaactgtgcagcgcctgctgccagtgctgtgccaggctcacggactgacccccgaacaggtggtggccattgccagcaacggcggcggcaagcaggccctggaaaccgtgcagagactgctgcccgtgctgtgccaggcccatggcctgacacctgaacaggtggtggctatcgcctctaacggcggaggaaaacaggctctggaaacagtgcagcggctgctgcctgtgctgtgtcaggctcacggcttgactccagaacaggtggtggctattgcttcccacgacggggggaaacaggccctggaaactgtgcagcgcctgctgccagtgctgtgccaggctcacgggctgacccccgaacaggtggtggccattgccagcaacggcggcggcaagcaggccctggaaaccgtgcagagactgctgcccgtgctgtgccaggcccatggcctgacacctgaacaggtggtggctatcgcctctaacaagggaggaaaacaggctctggaaacagtgcagcggctgctgcctgtgctgtgtcaggctcacggcttgactccagaacaggtggtggctattgcttccaatattggggggaaacaggccctggaaactgtgcagcgcctgctgccagtgctgtgccaggctcacggtttgacccccgaacaggtggtggccattgccagccacgacggcggcaagcaggccctggaaaccgtgcagagactgctgcccgtgctgtgccaggcccatggcctgacacctgaacaggtggtggctatcgcctctaatatcggaggaaaacaggctctggaaacagtgcagcggctgctgcctgtgctgtgtcaggctcacggcttgactccacagcaggtcgtggcaattgctagcaacggcggcggacggcccgccctggagagcattgtggcccagctgtctagacctgatcctgccctggccgccctgacaaatgatcacctggtggccctggcctgtctgggaggcagacctgccctggatgccgtgaaaaaaggactgcctcacgcccctgccctgatcaagagaacaaatagaagaatccccgagcggacctctcacagagtggccgatcacgcccaggtggtgagagtgctgggattttttcagtgtcactctcaccctgcccaggcctttgatgatgccatgacacagtttggcatgagcagacacggactgctgcagctgtttagaagagtgggagtgacagaactggaggccagatccggaaccctgcctcctgcctctcagagatgggataggattctgcagggatcccagccccaagaagaagagaaaggtggaggccagcggtggcggctcaaagcttggtggcggctcaactagttaagggcccggcgcgcctaaggtacccccgggtctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgccatgcat

SEQ ID NO: 15 - DNA, 8184 bp, Artificial Sequence
  plasmid construct
attcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgccatgcattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgaattcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagggcccggcgcgcctaaggtacccccgggtctagagatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgccc

SEQ ID NO: 16 - DNA, 8035 bp, Artificial Sequence
  plasmid construct
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgaattcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgacgtggacctgagaacactgggatattctcagcagcagcaggagaagatcaagcccaaggtgagatccacagtggcccagcaccacgaagccctggtgggacacggatttacacacgcccacattgtggccctgtctcagcaccctgccgccctgggaacagtggccgtgaaatatcaggatatgattgccgccctgcctgaggccacacacgaagccattgtgggagtgggaaaacagtggtctggagccagagccctggaagccctgctgacagtggccggagaactgagaggacctcctctgcagctggatacaggacagctgctgaagattgccaaaaggggcggagtgaccgcggtggaagccgtgcacgcctggagaaatgccctgacaggagcccctctgaacctgacccccgaacaggtggtggccattgccagccacgacggcggcaagcaggccctggaaaccgtgcagagactgctgcccgtgctgtgccaggcccatggcctgacacctgaacaggtggtggctatcgcctctaacggcggaggaaaacaggctctggaaacagtgcagcggctgctgcctgtgctgtgtcaggctcacggcttgactccagaacaggtggtggctattgcttccaatattggggggaaacaggccctggaaactgtgcagcgcctgctgccagtgctgtgccaggctcacggactgacccccgaacaggtggtggccattgccagcaacaagggcggcaagcaggccctggaaaccgtgcagagactgctgcccgtgctgtgccaggcccatggcctgacacctgaacaggtggtggctatcgcctctaatatcggaggaaaacaggctctggaaacagtgcagcggctgctgcctgtgctgtgtcaggctcacggcttgactccagaacaggtggtggctattgcttcccacgacggggggaaacaggccctggaaactgtgcagcgcctgctgccagtgctgtgccaggctcacgggctgacccccgaacaggtggtggccattgccagcaacggcggcggcaagcaggccctggaaaccgtgcagagactgctgcccgtgctgtgccaggcccatggcctgacacctgaacaggtggtggctatcgcctctcacgacggaggaaaacaggctctggaaacagtgcagcggctgctgcctgtgctgtgtcaggctcacggcttgactccagaacaggtggtggctattgcttccaacggcggggggaaacaggccctggaaactgtgcagcgcctgctgccagtgctgtgccaggctcacggtttgacccccgaacaggtggtggccattgccagcaacggcggcggcaagcaggccctggaaaccgtgcagagactgctgcccgtgctgtgccaggcccatggcctgacacctgaacaggtggtggctatcgcctctcacgacggaggaaaacaggctctggaaacagtgcagcggctgctgcctgtgctgtgtcaggctcacggcttgactccagaacaggtggtggctattgcttccaatattggggggaaacaggccctggaaactgtgcagcgcctgctgccagtgctgtgccaggctcacggcctcactcccgaacaggtggtggccattgccagccacgacggcggcaagcaggccctggaaaccgtgcagagactgctgcccgtgctgtgccaggcccatggcctgacacctgaacaggtggtggctatcgcctctaatatcggaggaaaacaggctctggaaacagtgcagcggctgctgcctgtgctgtgtcaggctcacggcttgactccagaacaggtggtggctattgcttccaatattggggggaaacaggccctggaaactgtgcagcgcctgctgccagtgctgtgccaggctcacggactgacccccgaacaggtggtggccattgccagcaacggcggcggcaagcaggccctggaaaccgtgcagagactgctgcccgtgctgtgccaggcccatggcctgacacctgaacaggtggtggctatcgcctctaacaagggaggaaaacaggctctggaaacagtgcagcggctgctgcctgtgctgtgtcaggctcacggcttgactccagaacaggtggtggctattgcttccaacggcggggggaaacaggccctggaaactgtgcagcgcctgctgccagtgctgtgccaggctcacgggctgacccccgaacaggtggtggccattgccagcaacggcggcggcaagcaggccctggaaaccgtgcagagactgctgcccgtgctgtgccaggcccatggcctgacacctgaacaggtggtggctatcgcctctcacgacggaggaaaacaggctctggaaacagtgcagcggctgctgcctgtgctgtgtcaggctcacggcttgactccagaacaggtggtggctattgcttccaacggcggggggaaacaggccctggaaactgtgcagcgcctgctgccagtgctgtgccaggctcacggtttgacccccgaacaggtggtggccattgccagcaacggcggcggcaagcaggccctggaaaccgtgcagagactgctgcccgtgctgtgccaggcccatggcctgacacctgaacaggtggtggctatcgcctctaatatcggaggaaaacaggctctggaaacagtgcagcggctgctgcctgtgctgtgtcaggctcacggcttgactccacagcaggtcgtggcaattgctagcaacggcggcggacggcccgccctggagagcattgtggcccagctgtctagacctgatcctgccctggccgccctgacaaatgatcacctggtggccctggcctgtctgggaggcagacctgccctggatgccgtgaaaaaaggactgcctcacgcccctgccctgatcaagagaacaaatagaagaatccccgagcggacctctcacagagtggccgatcacgcccaggtggtgagagtgctgggattttttcagtgtcactctcaccctgcccaggcctttgatgatgccatgacacagtttggcatgagcagacacggactgctgcagctgtttagaagagtgggagtgacagaactggaggccagatccggaaccctgcctcctgcctctcagagatgggataggattctgcagggatcccagccccaagaagaagagaaaggtggaggccagcggtggcggctcaaagcttggtggcggctcaactagttaagggcccggcgcgcctaaggtacccccgggtctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgccatgcat

SEQ ID NO: 17 - DNA, 8184 bp, Artificial Sequence
  plasmid construct
ggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgccatgcattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgaattcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagggcccggcgcgcctaaggtacccccgggtctagagatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcagg

SEQ ID NO: 18 - DNA, 7423 bp, Artificial Sequence
  plasmid construct
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgaattcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgacgtggacctgagaacactgggatattctcagcagcagcaggagaagatcaagcccaaggtgagatccacagtggcccagcaccacgaagccctggtgggacacggatttacacacgcccacattgtggccctgtctcagcaccctgccgccctgggaacagtggccgtgaaatatcaggatatgattgccgccctgcctgaggccacacacgaagccattgtgggagtgggaaaacagtggtctggagccagagccctggaagccctgctgacagtggccggagaactgagaggacctcctctgcagctggatacaggacagctgctgaagattgccaaaaggggcggagtgaccgcggtggaagccgtgcacgcctggagaaatgccctgacaggagcccctctgaacctgacccccgaacaggtggtggccattgccagcaacatcggcggcaagcaggccctggaaaccgtgcagagactgctgcccgtgctgtgccaggcccatggcctgacacctgaacaggtggtggctatcgcctctaacaagggaggaaaacaggctctggaaacagtgcagcggctgctgcctgtgctgtgtcaggctcacggcttgactccagaacaggtggtggctattgcttccaacggcggggggaaacaggccctggaaactgtgcagcgcctgctgccagtgctgtgccaggctcacggactgacccccgaacaggtggtggccattgccagccacgacggcggcaagcaggccctggaaaccgtgcagagactgctgcccgtgctgtgccaggcccatggcctgacacctgaacaggtggtggctatcgcctctaatatcggaggaaaacaggctctggaaacagtgcagcggctgctgcctgtgctgtgtcaggctcacggcttgactccagaacaggtggtggctattgcttccaacaagggggggaaacaggccctggaaactgtgcagcgcctgctgccagtgctgtgccaggctcacgggctgacccccgaacaggtggtggccattgccagccacgacggcggcaagcaggccctggaaaccgtgcagagactgctgcccgtgctgtgccaggcccatggcctgacacctgaacaggtggtggctatcgcctctaatatcggaggaaaacaggctctggaaacagtgcagcggctgctgcctgtgctgtgtcaggctcacggcttgactccagaacaggtggtggctattgcttcccacgacggggggaaacaggccctggaaactgtgcagcgcctgctgccagtgctgtgccaggctcacggcctcactcccgaacaggtggtggccattgccagccacgacggcggcaagcaggccctggaaaccgtgcagagactgctgcccgtgctgtgccaggcccatggcctgacacctgaacaggtggtggctatcgcctctaatatcggaggaaaacaggctctggaaacagtgcagcggctgctgcctgtgctgtgtcaggctcacggcttgactccagaacaggtggtggctattgcttccaacaagggggggaaacaggccctggaaactgtgcagcgcctgctgccagtgctgtgccaggctcacggactgacccccgaacaggtggtggccattgccagcaacaagggcggcaagcaggccctggaaaccgtgcagagactgctgcccgtgctgtgccaggcccatggcctgacacctgaacaggtggtggctatcgcctctcacgacggaggaaaacaggctctggaaacagtgcagcggctgctgcctgtgctgtgtcaggctcacggcttgactccagaacaggtggtggctattgcttccaatattggggggaaacaggccctggaaactgtgcagcgcctgctgccagtgctgtgccaggctcacgggctgacccccgaacaggtggtggccattgccagcaacggcggcggcaagcaggccctggaaaccgtgcagagactgctgcccgtgctgtgccaggcccatggcctgacacctgaacaggtggtggctatcgcctctaacggcggaggaaaacaggctctggaaacagtgcagcggctgctgcctgtgctgtgtcaggctcacggcttgactccacagcaggtcgtggcaattgctagcaacggcggcggacggcccgccctggagagcattgtggcccagctgtctagacctgatcctgccctggccgccctgacaaatgatcacctggtggccctggcctgtctgggaggcagacctgccctggatgccgtgaaaaaaggactgcctcacgcccctgccctgatcaagagaacaaatagaagaatccccgagcggacctctcacagagtggccgatcacgcccaggtggtgagagtgctgggattttttcagtgtcactctcaccctgcccaggcctttgatgatgccatgacacagtttggcatgagcagacacggactgctgcagctgtttagaagagtgggagtgacagaactggaggccagatccggaaccctgcctcctgcctctcagagatgggataggattctgcagggatcccagccccaagaagaagagaaaggtggaggccagcggtggcggctcaaagcttggtggcggctcaactagttaagggcccggcgcgcctaaggtacccccgggtctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgccatgcat

SEQ ID NO: 19 - DNA, 7423 bp, Artificial Sequence; identical to SEQ ID NO: 18
  plasmid construct

SEQ ID NO: 20 - DNA, 7423 bp, Artificial Sequence
  plasmid construct
tagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgaattcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgacgtggacctgagaacactgggatattctcagcagcagcaggagaagatcaagcccaaggtgagatccacagtggcccagcaccacgaagccctggtgggacacggatttacacacgcccacattgtggccctgtctcagcaccctgccgccctgggaacagtggccgtgaaatatcaggatatgattgccgccctgcctgaggccacacacgaagccattgtgggagtgggaaaacagtggtctggagccagagccctggaagccctgctgacagtggccggagaactgagaggacctcctctgcagctggatacaggacagctgctgaagattgccaaaaggggcggagtgaccgcggtggaagccgtgcacgcctggagaaatgccctgacaggagcccctctgaacctgacccccgaacaggtggtggccattgccagcaacatcggcggcaagcaggccctggaaaccgtgcagagactgctgcccgtgctgtgccaggcccatggcctgacacctgaacaggtggtggctatcgcctctaacaagggaggaaaacaggctctggaaacagtgcagcggctgctgcctgtgctgtgtcaggctcacggcttgactccagaacaggtggtggctattgcttccaatattggggggaaacaggccctggaaactgtgcagcgcctgctgccagtgctgtgccaggctcacggactgacccccgaacaggtggtggccattgccagccacgacggcggcaagcaggccctggaaaccgtgcagagactgctgcccgtgctgtgccaggcccatggcctgacacctgaacaggtggtggctatcgcctctaatatcggaggaaaacaggctctggaaacagtgcagcggctgctgcctgtgctgtgtcaggctcacggcttgactccagaacaggtggtggctattgcttccaatattggggggaaacaggccctggaaactgtgcagcgcctgctgccagtgctgtgccaggctcacgggctgacccccgaacaggtggtggccattgccagcaacatcggcggcaagcaggccctggaaaccgtgcagagactgctgcccgtgctgtgccaggcccatggcctgacacctgaacaggtggtggctatcgcctctcacgacggaggaaaacaggctctggaaacagtgcagcggctgctgcctgtgctgtgtcaggctcacggcttgactccagaacaggtggtggctattgcttcccacgacggggggaaacaggccctggaaactgtgcagcgcctgctgccagtgctgtgccaggctcacggcctcactcccgaacaggtggtggccattgccagcaacatcggcggcaagcaggccctggaaaccgtgcagagactgctgcccgtgctgtgccaggcccatggcctgacacctgaacaggtggtggctatcgcctctcacgacggaggaaaacaggctctggaaacagtgcagcggctgctgcctgtgctgtgtcaggctcacggcttgactccagaacaggtggtggctattgcttccaatattggggggaaacaggccctggaaactgtgcagcgcctgctgccagtgctgtgccaggctcacggactgacccccgaacaggtggtggccattgccagcaacatcggcggcaagcaggccctggaaaccgtgcagagactgctgcccgtgctgtgccaggcccatggcctgacacctgaacaggtggtggctatcgcctctcacgacggaggaaaacaggctctggaaacagtgcagcggctgctgcctgtgctgtgtcaggctcacggcttgactccagaacaggtggtggctattgcttccaacggcggggggaaacaggccctggaaactgtgcagcgcctgctgccagtgctgtgccaggctcacgggctgacccccgaacaggtggtggccattgccagccacgacggcggcaagcaggccctggaaaccgtgcagagactgctgcccgtgctgtgccaggcccatggcctgacacctgaacaggtggtggctatcgcctctaacggcggaggaaaacaggctctggaaacagtgcagcggctgctgcctgtgctgtgtcaggctcacggcttgactccacagcaggtcgtggcaattgctagcaacggcggcggacggcccgccctggagagcattgtggcccagctgtctagacctgatcctgccctggccgccctgacaaatgatcacctggtggccctggcctgtctgggaggcagacctgccctggatgccgtgaaaaaaggactgcctcacgcccctgccctgatcaagagaacaaatagaagaatccccgagcggacctctcacagagtggccgatcacgcccaggtggtgagagtgctgggattttttcagtgtcactctcaccctgcccaggcctttgatgatgccatgacacagtttggcatgagcagacacggactgctgcagctgtttagaagagtgggagtgacagaactggaggccagatccggaaccctgcctcctgcctctcagagatgggataggattctgcagggatcccagccccaagaagaagagaaaggtggaggccagcggtggcggctcaaagcttggtggcggctcaactagttaagggcccggcgcgcctaaggtacccccgggtctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgccatgcat

SEQ ID NO: 21 - DNA, 7788 bp, Artificial Sequence
  plasmid construct
gagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgccatgcattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgaattcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtatgtcgcggacccggctcccttccccacccgcacccagcccagcgttttcggccgactcgttctcagacctgcttaggcagttcgacccctcactgtttaacacatcgttgttcgactcccttcctccgtttggggcgcaccatacggaggcggccaccggggagtgggatgaggtgcagtcgggattgagagctgcggatgcaccacccccaaccatgcgggtggccgtcaccgctgcccgaccgccgagggcgaagcccgcaccaaggcggagggcagcgcaaccgtccgacgcaagccccgcagcgcaagtagatttgagaactttgggatattcacagcagcagcaggaaaagatcaagcccaaagtgaggtcgacagtcgcgcagcatcacgaagcgctggtgggtcatgggtttacacatgcccacatcgtagccttgtcgcagcaccctgcagcccttggcacggtcgccgtcaagtaccaggacatgattgcggcgttgccggaagccacacatgaggcgatcgtcggtgtggggaaacagtggagcggagcccgagcgcttgaggccctgttgacggtcgcgggagagctgagagggcctccccttcagctggacacgggccagttgctgaagatcgcgaagcggggaggagtcacggcggtcgaggcggtgcacgcgtggcgcaatgcgctcacgggagcacccctcaacctgaccccagagcaggtcgtggcaattgcgagcaacaacgggggaaagcaggcactcgaaaccgtccagaggttgctgcctgtgctgtgccaagcgcacggacttacgccagagcaggtcgtggcaattgcgagcaacaacgggggaaagcaggcactcgaaaccgtccagaggttgctgcctgtgctgtgccaagcgcacggactaaccccagagcaggtcgtggcaattgcgagcaacggagggggaaagcaggcactcgaaaccgtccagaggttgctgcctgtgctgtgccaagcgcacgggttgaccccagagcaggtcgtggcaattgcgagcaacatcgggggaaagcaggcactcgaaaccgtccagaggttgctgcctgtgctgtgccaagcgcacggcctgaccccagagcaggtcgtggcaattgcgagcaacaacgggggaaagcaggcactcgaaaccgtccagaggttgctgcctgtgctgtgccaagcgcacggactgacaccagagcaggtcgtggcaattgcgagcaacatcgggggaaagcaggcactcgaaaccgtccagaggttgctgcctgtgctgtgccaagcgcacggacttacacccgaacaagtcgtggcaattgcgagccatgacgggggaaagcaggcactcgaaaccgtccagaggttgctgcctgtgctgtgccaagcgcacggacttacgccagagcaggtcgtggcaattgcgagccatgacgggggaaagcaggcactcgaaaccgtccagaggttgctgcctgtgctgtgccaagcgcacggactaaccccagagcaggtcgtggcaattgcgagcaacggagggggaaagcaggcactcgaaaccgtccagaggttgctgcctgtgctgtgccaagcgcacgggttgaccccagagcaggtcgtggcaattgcgagcaacggagggggaaagcaggcactcgaaaccgtccagaggttgctgcctgtgctgtgccaagcgcacggcctgaccccagagcaggtcgtggcaattgcgagcaacatcgggggaaagcaggcactcgaaaccgtccagaggttgctgcctgtgctgtgccaagcgcacggactgacaccagagcaggtcgtggcaattgcgagcaacaacgggggaaagcaggcactcgaaaccgtccagaggttgctgcctgtgctgtgccaagcgcacggcctcaccccagagcaggtcgtggcaattgcgagcaacaacgggggaaagcaggcactcgaaaccgtccagaggttgctgcctgtgctgtgccaagcgcacggacttacgccagagcaggtcgtggcaattgcgagcaacaacgggggaaagcaggcactcgaaaccgtccagaggttgctgcctgtgctgtgccaagcgcacggactaaccccagagcaggtcgtggcaattgcgagccatgacgggggaaagcaggcactcgaaaccgtccagaggttgctgcctgtgctgtgccaagcgcacgggttgaccccagagcaggtcgtggcaattgcgagcaacggagggggaaagcaggcactcgaaaccgtccagaggttgctgcctgtgctgtgccaagcgcacggactcacgcctgagcaggtagtggctattgcatccaatatcgggggcagacccgcactggagtcaatcgtggcccagctttcgaggccggaccccgcgctggccgcactcactaatgatcatcttgtagcgctggcctgcctcggcggacgacccgccttggatgcggtgaagaaggggctcccgcacgcgcctgcattgattaagcggaccaacagaaggattcccgagaggacatcacatcgagtggcagatcacgcgcaagtggtccgcgtgctcggattcttccagtgtcactcccaccccgcacaagcgttcgatgacgccatgactcaatttggtatgtcgagacacggactgctgcagctctttcgtagagtcggtgtcacagaactcgaggcccgctcgggcacactgcctcccgcctcccagcggtgggacaggattctccaagcgagcggtatgaaacgcgcgaagccttcacctacgtcaactcagacacctgaccaggcgagccttcatgcgttcgcagactcgctggagagggatttggacgcgccctcgcccatgcatgaaggggaccaaactcgcgcgtcagctagccccaagaagaagagaaaggtggaggccagcccatggggcggaggttcgaagcttggtggcggctcaactagttaagggcccggcgcgcctaaggtacccccgggtctagagatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagc

SEQ ID NO: 22 - DNA, 7380 bp, Artificial Sequence
  plasmid construct
gatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgccatgcattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgaattcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtatgtcgcggacccggctcccttccccacccgcacccagcccagcgttttcggccgactcgttctcagacctgcttaggcagttcgacccctcactgtttaacacatcgttgttcgactcccttcctccgtttggggcgcaccatacggaggcggccaccggggagtgggatgaggtgcagtcgggattgagagctgcggatgcaccacccccaaccatgcgggtggccgtcaccgctgcccgaccgccgagggcgaagcccgcaccaaggcggagggcagcgcaaccgtccgacgcaagccccgcagcgcaagtagatttgagaactttgggatattcacagcagcagcaggaaaagatcaagcccaaagtgaggtcgacagtcgcgcagcatcacgaagcgctggtgggtcatgggtttacacatgcccacatcgtagccttgtcgcagcaccctgcagcccttggcacggtcgccgtcaagtaccaggacatgattgcggcgttgccggaagccacacatgaggcgatcgtcggtgtggggaaacagtggagcggagcccgagcgcttgaggccctgttgacggtcgcgggagagctgagagggcctccccttcagctggacacgggccagttgctgaagatcgcgaagcggggaggagtcacggcggtcgaggcggtgcacgcgtggcgcaatgcgctcacgggagcacccctcaacctgaccccagagcaggtcgtggcgatcgcaagccacgacggaggaaagcaagccttggaaacagtacagaggctgttgcctgtgctgtgccaagcgcacggactcaccccagagcaggtcgtggcgatcgcaagccacgacggaggaaagcaagccttggaaacagtacagaggctgttgcctgtgctgtgccaagcgcacggcctcaccccagagcaggtcgtggcaatcgcgagcaataacggcggaaaacaggctttggaaacggtgcagaggctccttccagtgctgtgccaagcgcacggattaaccccagagcaggtcgtggcgatcgcaagccacgacggaggaaagcaagccttggaaacagtacagaggctgttgcctgtgctgtgccaagcgcacggcttaaccccagagcaggtcgtggcgatcgcaagccacgacggaggaaagcaagccttggaaacagtacagaggctgttgcctgtgctgtgccaagcgcacggacttaccccagagcaggtcgtggccattgcctcgaatggagggggcaaacaggcgttggaaaccgtacaacgattgctgccggtgctgtgccaagcgcacggccttaccccagagcaggtcgtggcgatcgcaagccacgacggaggaaagcaagccttggaaacagtacagaggctgttgcctgtgctgtgccaagcgcacggactaaccccagagcaggtcgtggcgatcgcaagccacgacggaggaaagcaagccttggaaacagtacagaggctgttgcctgtgctgtgccaagcgcacgggctcaccccagagcaggtcgtggcgatcgcaagccacgacggaggaaagcaagccttggaaacagtacagaggctgttgcctgtgctgtgccaagcgcacgggctaaccccagagcaggtcgtggccattgcctcgaatggagggggcaaacaggcgttggaaaccgtacaacgattgctgccggtgctgtgccaagcgcacggcctaaccccagagcaggtcgtggcgatcgcaagccacgacggaggaaagcaagccttggaaacagtacagaggctgttgcctgtgctgtgccaagcgcacgggttaaccccagagcaggtcgtggccattgcctcgaatggagggggcaaacaggcgttggaaaccgtacaacgattgctgccggtgctgtgccaagcgcacggactcacgcctgagcaggtagtggctattgcatcccatgacgggggcagacccgcactggagtcaatcgtggcccagctttcgaggccggaccccgcgctggccgcactcactaatgatcatcttgtagcgctggcctgcctcggcggacgacccgccttggatgcggtgaagaaggggctcccgcacgcgcctgcattgattaagcggaccaacagaaggattcccgagaggacatcacatcgagtggcagatcacgcgcaagtggtccgcgtgctcggattcttccagtgtcactcccaccccgcacaagcgttcgatgacgccatgactcaatttggtatgtcgagacacggactgctgcagctctttcgtagagtcggtgtcacagaactcgaggcccgctcgggcacactgcctcccgcctcccagcggtgggacaggattctccaagcgagcggtatgaaacgcgcgaagccttcacctacgtcaactcagacacctgaccaggcgagccttcatgcgttcgcagactcgctggagagggatttggacgcgccctcgcccatgcatgaaggggaccaaactcgcgcgtcagctagccccaagaagaagagaaaggtggaggccagcccatggggcggaggttcgaagcttggtggcggctcaactagttaagggcccggcgcgcctaaggtacccccgggtctagagatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggat

SEQ ID NO: 23 - DNA, 7380 bp, Artificial Sequence
  plasmid construct
actggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgccatgcattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgaattcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtatgtcgcggacccggctcccttccccacccgcacccagcccagcgttttcggccgactcgttctcagacctgcttaggcagttcgacccctcactgtttaacacatcgttgttcgactcccttcctccgtttggggcgcaccatacggaggcggccaccggggagtgggatgaggtgcagtcgggattgagagctgcggatgcaccacccccaaccatgcgggtggccgtcaccgctgcccgaccgccgagggcgaagcccgcaccaaggcggagggcagcgcaaccgtccgacgcaagccccgcagcgcaagtagatttgagaactttgggatattcacagcagcagcaggaaaagatcaagcccaaagtgaggtcgacagtcgcgcagcatcacgaagcgctggtgggtcatgggtttacacatgcccacatcgtagccttgtcgcagcaccctgcagcccttggcacggtcgccgtcaagtaccaggacatgattgcggcgttgccggaagccacacatgaggcgatcgtcggtgtggggaaacagtggagcggagcccgagcgcttgaggccctgttgacggtcgcgggagagctgagagggcctccccttcagctggacacgggccagttgctgaagatcgcgaagcggggaggagtcacggcggtcgaggcggtgcacgcgtggcgcaatgcgctcacgggagcacccctcaacctgaccccagagcaggtcgtggcaatcgcctccaacattggcgggaaacaggcactcgagactgtccagcgcctgcttcccgtgctgtgccaagcgcacggactcaccccagagcaggtcgtggccattgcctcgaatggagggggcaaacaggcgttggaaaccgtacaacgattgctgccggtgctgtgccaagcgcacggcctcaccccagagcaggtcgtggcaatcgcgagcaataacggcggaaaacaggctttggaaacggtgcagaggctccttccagtgctgtgccaagcgcacggattaaccccagagcaggtcgtggcaatcgcctccaacattggcgggaaacaggcactcgagactgtccagcgcctgcttcccgtgctgtgccaagcgcacggcttaaccccagagcaggtcgtggccattgcctcgaatggagggggcaaacaggcgttggaaaccgtacaacgattgctgccggtgctgtgccaagcgcacggacttaccccagagcaggtcgtggccattgcctcgaatggagggggcaaacaggcgttggaaaccgtacaacgattgctgccggtgctgtgccaagcgcacggccttaccccagagcaggtcgtggccattgcctcgaatggagggggcaaacaggcgttggaaaccgtacaacgattgctgccggtgctgtgccaagcgcacggactaaccccagagcaggtcgtggcaatcgcctccaacattggcgggaaacaggcactcgagactgtccagcgcctgcttcccgtgctgtgccaagcgcacgggctcaccccagagcaggtcgtggccattgcctcgaatggagggggcaaacaggcgttggaaaccgtacaacgattgctgccggtgctgtgccaagcgcacgggctaaccccagagcaggtcgtggccattgcctcgaatggagggggcaaacaggcgttggaaaccgtacaacgattgctgccggtgctgtgccaagcgcacggcctaaccccagagcaggtcgtggcaatcgcctccaacattggcgggaaacaggcactcgagactgtccagcgcctgcttcccgtgctgtgccaagcgcacgggttaaccccagagcaggtcgtggccattgcctcgaatggagggggcaaacaggcgttggaaaccgtacaacgattgctgccggtgctgtgccaagcgcacggactcacgcctgagcaggtagtggctattgcatccaatatcgggggcagacccgcactggagtcaatcgtggcccagctttcgaggccggaccccgcgctggccgcactcactaatgatcatcttgtagcgctggcctgcctcggcggacgacccgccttggatgcggtgaagaaggggctcccgcacgcgcctgcattgattaagcggaccaacagaaggattcccgagaggacatcacatcgagtggcagatcacgcgcaagtggtccgcgtgctcggattcttccagtgtcactcccaccccgcacaagcgttcgatgacgccatgactcaatttggtatgtcgagacacggactgctgcagctctttcgtagagtcggtgtcacagaactcgaggcccgctcgggcacactgcctcccgcctcccagcggtgggacaggattctccaagcgagcggtatgaaacgcgcgaagccttcacctacgtcaactcagacacctgaccaggcgagccttcatgcgttcgcagactcgctggagagggatttggacgcgccctcgcccatgcatgaaggggaccaaactcgcgcgtcagctagccccaagaagaagagaaaggtggaggccagcccatggggcggaggttcgaagcttggtggcggctcaactagttaagggcccggcgcgcctaaggtacccccgggtctagagatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaaggg

SEQ ID NO: 24 - DNA, 7380 bp, Artificial Sequence
  plasmid construct
agcttggtggcggctcaactagttaagggcccggcgcgcctaaggtacccccgggtctagagatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgccatgcattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgaattcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtatgtcgcggacccggctcccttccccacccgcacccagcccagcgttttcggccgactcgttctcagacctgcttaggcagttcgacccctcactgtttaacacatcgttgttcgactcccttcctccgtttggggcgcaccatacggaggcggccaccggggagtgggatgaggtgcagtcgggattgagagctgcggatgcaccacccccaaccatgcgggtggccgtcaccgctgcccgaccgccgagggcgaagcccgcaccaaggcggagggcagcgcaaccgtccgacgcaagccccgcagcgcaagtagatttgagaactttgggatattcacagcagcagcaggaaaagatcaagcccaaagtgaggtcgacagtcgcgcagcatcacgaagcgctggtgggtcatgggtttacacatgcccacatcgtagccttgtcgcagcaccctgcagcccttggcacggtcgccgtcaagtaccaggacatgattgcggcgttgccggaagccacacatgaggcgatcgtcggtgtggggaaacagtggagcggagcccgagcgcttgaggccctgttgacggtcgcgggagagctgagagggcctccccttcagctggacacgggccagttgctgaagatcgcgaagcggggaggagtcacggcggtcgaggcggtgcacgcgtggcgcaatgcgctcacgggagcacccctcaacctgaccccagagcaggtcgtggcaatcgcctccaacattggcgggaaacaggcactcgagactgtccagcgcctgcttcccgtgctgtgccaagcgcacggactcaccccagagcaggtcgtggcaatcgcgagcaataacggcggaaaacaggctttggaaacggtgcagaggctccttccagtgctgtgccaagcgcacggcctcaccccagagcaggtcgtggcaatcgcgagcaataacggcggaaaacaggctttggaaacggtgcagaggctccttccagtgctgtgccaagcgcacggattaaccccagagcaggtcgtggcaatcgcctccaacattggcgggaaacaggcactcgagactgtccagcgcctgcttcccgtgctgtgccaagcgcacggcttaaccccagagcaggtcgtggcaatcgcgagcaataacggcggaaaacaggctttggaaacggtgcagaggctccttccagtgctgtgccaagcgcacggacttaccccagagcaggtcgtggccattgcctcgaatggagggggcaaacaggcgttggaaaccgtacaacgattgctgccggtgctgtgccaagcgcacggccttaccccagagcaggtcgtggcaatcgcgagcaataacggcggaaaacaggctttggaaacggtgcagaggctccttccagtgctgtgccaagcgcacggactaaccccagagcaggtcgtggcaatcgcctccaacattggcgggaaacaggcactcgagactgtccagcgcctgcttcccgtgctgtgccaagcgcacgggctcaccccagagcaggtcgtggcaatcgcgagcaataacggcggaaaacaggctttggaaacggtgcagaggctccttccagtgctgtgccaagcgcacgggctaaccccagagcaggtcgtggccattgcctcgaatggagggggcaaacaggcgttggaaaccgtacaacgattgctgccggtgctgtgccaagcgcacggcctaaccccagagcaggtcgtggcaatcgcctccaacattggcgggaaacaggcactcgagactgtccagcgcctgcttcccgtgctgtgccaagcgcacgggttaaccccagagcaggtcgtggccattgcctcgaatggagggggcaaacaggcgttggaaaccgtacaacgattgctgccggtgctgtgccaagcgcacggactcacgcctgagcaggtagtggctattgcatccaatatcgggggcagacccgcactggagtcaatcgtggcccagctttcgaggccggaccccgcgctggccgcactcactaatgatcatcttgtagcgctggcctgcctcggcggacgacccgccttggatgcggtgaagaaggggctcccgcacgcgcctgcattgattaagcggaccaacagaaggattcccgagaggacatcacatcgagtggcagatcacgcgcaagtggtccgcgtgctcggattcttccagtgtcactcccaccccgcacaagcgttcgatgacgccatgactcaatttggtatgtcgagacacggactgctgcagctctttcgtagagtcggtgtcacagaactcgaggcccgctcgggcacactgcctcccgcctcccagcggtgggacaggattctccaagcgagcggtatgaaacgcgcgaagccttcacctacgtcaactcagacacctgaccaggcgagccttcatgcgttcgcagactcgctggagagggatttggacgcgccctcgcccatgcatgaaggggaccaaactcgcgcgtcagctagccccaagaagaagagaaaggtggaggccagcccatggggcggaggttcga

SEQ ID NO: 25 - DNA, 7380 bp, Artificial Sequence
  plasmid construct
atcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgccatgcattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgaattcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtatgtcgcggacccggctcccttccccacccgcacccagcccagcgttttcggccgactcgttctcagacctgcttaggcagttcgacccctcactgtttaacacatcgttgttcgactcccttcctccgtttggggcgcaccatacggaggcggccaccggggagtgggatgaggtgcagtcgggattgagagctgcggatgcaccacccccaaccatgcgggtggccgtcaccgctgcccgaccgccgagggcgaagcccgcaccaaggcggagggcagcgcaaccgtccgacgcaagccccgcagcgcaagtagatttgagaactttgggatattcacagcagcagcaggaaaagatcaagcccaaagtgaggtcgacagtcgcgcagcatcacgaagcgctggtgggtcatgggtttacacatgcccacatcgtagccttgtcgcagcaccctgcagcccttggcacggtcgccgtcaagtaccaggacatgattgcggcgttgccggaagccacacatgaggcgatcgtcggtgtggggaaacagtggagcggagcccgagcgcttgaggccctgttgacggtcgcgggagagctgagagggcctccccttcagctggacacgggccagttgctgaagatcgcgaagcggggaggagtcacggcggtcgaggcggtgcacgcgtggcgcaatgcgctcacgggagcacccctcaacctgaccccagagcaggtcgtggcaatcgcctccaacattggcgggaaacaggcactcgagactgtccagcgcctgcttcccgtgctgtgccaagcgcacggactcaccccagagcaggtcgtggcgatcgcaagccacgacggaggaaagcaagccttggaaacagtacagaggctgttgcctgtgctgtgccaagcgcacggcctcaccccagagcaggtcgtggcaatcgcctccaacattggcgggaaacaggcactcgagactgtccagcgcctgcttcccgtgctgtgccaagcgcacggattaaccccagagcaggtcgtggcaatcgcctccaacattggcgggaaacaggcactcgagactgtccagcgcctgcttcccgtgctgtgccaagcgcacggcttaaccccagagcaggtcgtggcgatcgcaagccacgacggaggaaagcaagccttggaaacagtacagaggctgttgcctgtgctgtgccaagcgcacggacttaccccagagcaggtcgtggcaatcgcctccaacattggcgggaaacaggcactcgagactgtccagcgcctgcttcccgtgctgtgccaagcgcacggccttaccccagagcaggtcgtggcgatcgcaagccacgacggaggaaagcaagccttggaaacagtacagaggctgttgcctgtgctgtgccaagcgcacggactaaccccagagcaggtcgtggcaatcgcctccaacattggcgggaaacaggcactcgagactgtccagcgcctgcttcccgtgctgtgccaagcgcacgggctcaccccagagcaggtcgtggcgatcgcaagccacgacggaggaaagcaagccttggaaacagtacagaggctgttgcctgtgctgtgccaagcgcacgggctaaccccagagcaggtcgtggccattgcctcgaatggagggggcaaacaggcgttggaaaccgtacaacgattgctgccggtgctgtgccaagcgcacggcctaaccccagagcaggtcgtggcaatcgcctccaacattggcgggaaacaggcactcgagactgtccagcgcctgcttcccgtgctgtgccaagcgcacgggttaaccccagagcaggtcgtggccattgcctcgaatggagggggcaaacaggcgttggaaaccgtacaacgattgctgccggtgctgtgccaagcgcacggactcacgcctgagcaggtagtggctattgcatccaatatcgggggcagacccgcactggagtcaatcgtggcccagctttcgaggccggaccccgcgctggccgcactcactaatgatcatcttgtagcgctggcctgcctcggcggacgacccgccttggatgcggtgaagaaggggctcccgcacgcgcctgcattgattaagcggaccaacagaaggattcccgagaggacatcacatcgagtggcagatcacgcgcaagtggtccgcgtgctcggattcttccagtgtcactcccaccccgcacaagcgttcgatgacgccatgactcaatttggtatgtcgagacacggactgctgcagctctttcgtagagtcggtgtcacagaactcgaggcccgctcgggcacactgcctcccgcctcccagcggtgggacaggattctccaagcgagcggtatgaaacgcgcgaagccttcacctacgtcaactcagacacctgaccaggcgagccttcatgcgttcgcagactcgctggagagggatttggacgcgccctcgcccatgcatgaaggggaccaaactcgcgcgtcagctagccccaagaagaagagaaaggtggaggccagcccatggggcggaggttcgaagcttggtggcggctcaactagttaagggcccggcgcgcctaaggtacccccgggtctagagatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaac

SEQ ID NO: 26 - DNA, 7380 bp, Artificial Sequence
  plasmid construct
cagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgccatgcattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgaattcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtatgtcgcggacccggctcccttccccacccgcacccagcccagcgttttcggccgactcgttctcagacctgcttaggcagttcgacccctcactgtttaacacatcgttgttcgactcccttcctccgtttggggcgcaccatacggaggcggccaccggggagtgggatgaggtgcagtcgggattgagagctgcggatgcaccacccccaaccatgcgggtggccgtcaccgctgcccgaccgccgagggcgaagcccgcaccaaggcggagggcagcgcaaccgtccgacgcaagccccgcagcgcaagtagatttgagaactttgggatattcacagcagcagcaggaaaagatcaagcccaaagtgaggtcgacagtcgcgcagcatcacgaagcgctggtgggtcatgggtttacacatgcccacatcgtagccttgtcgcagcaccctgcagcccttggcacggtcgccgtcaagtaccaggacatgattgcggcgttgccggaagccacacatgaggcgatcgtcggtgtggggaaacagtggagcggagcccgagcgcttgaggccctgttgacggtcgcgggagagctgagagggcctccccttcagctggacacgggccagttgctgaagatcgcgaagcggggaggagtcacggcggtcgaggcggtgcacgcgtggcgcaatgcgctcacgggagcacccctcaacctgaccccagagcaggtcgtggccattgcctcgaatggagggggcaaacaggcgttggaaaccgtacaacgattgctgccggtgctgtgccaagcgcacggactcaccccagagcaggtcgtggccattgcctcgaatggagggggcaaacaggcgttggaaaccgtacaacgattgctgccggtgctgtgccaagcgcacggcctcaccccagagcaggtcgtggcaatcgcctccaacattggcgggaaacaggcactcgagactgtccagcgcctgcttcccgtgctgtgccaagcgcacggattaaccccagagcaggtcgtggccattgcctcgaatggagggggcaaacaggcgttggaaaccgtacaacgattgctgccggtgctgtgccaagcgcacggcttaaccccagagcaggtcgtggccattgcctcgaatggagggggcaaacaggcgttggaaaccgtacaacgattgctgccggtgctgtgccaagcgcacggacttaccccagagcaggtcgtggcgatcgcaagccacgacggaggaaagcaagccttggaaacagtacagaggctgttgcctgtgctgtgccaagcgcacggccttaccccagagcaggtcgtggcgatcgcaagccacgacggaggaaagcaagccttggaaacagtacagaggctgttgcctgtgctgtgccaagcgcacggactaaccccagagcaggtcgtggcgatcgcaagccacgacggaggaaagcaagccttggaaacagtacagaggctgttgcctgtgctgtgccaagcgcacgggctcaccccagagcaggtcgtggccattgcctcgaatggagggggcaaacaggcgttggaaaccgtacaacgattgctgccggtgctgtgccaagcgcacgggctaaccccagagcaggtcgtggcaatcgcgagcaataacggcggaaaacaggctttggaaacggtgcagaggctccttccagtgctgtgccaagcgcacggcctaaccccagagcaggtcgtggcaatcgcctccaacattggcgggaaacaggcactcgagactgtccagcgcctgcttcccgtgctgtgccaagcgcacgggttaaccccagagcaggtcgtggcgatcgcaagccacgacggaggaaagcaagccttggaaacagtacagaggctgttgcctgtgctgtgccaagcgcacggactcacgcctgagcaggtagtggctattgcatccaatatcgggggcagacccgcactggagtcaatcgtggcccagctttcgaggccggaccccgcgctggccgcactcactaatgatcatcttgtagcgctggcctgcctcggcggacgacccgccttggatgcggtgaagaaggggctcccgcacgcgcctgcattgattaagcggaccaacagaaggattcccgagaggacatcacatcgagtggcagatcacgcgcaagtggtccgcgtgctcggattcttccagtgtcactcccaccccgcacaagcgttcgatgacgccatgactcaatttggtatgtcgagacacggactgctgcagctctttcgtagagtcggtgtcacagaactcgaggcccgctcgggcacactgcctcccgcctcccagcggtgggacaggattctccaagcgagcggtatgaaacgcgcgaagccttcacctacgtcaactcagacacctgaccaggcgagccttcatgcgttcgcagactcgctggagagggatttggacgcgccctcgcccatgcatgaaggggaccaaactcgcgcgtcagctagccccaagaagaagagaaaggtggaggccagcccatggggcggaggttcgaagcttggtggcggctcaactagttaagggcccggcgcgcctaaggtacccccgggtctagagatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgc

SEQ ID NO: 27 - DNA, 7370 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtctaatacccaatctctcgtcttatccagatgttttatacgccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacgactcactatagaattctaggcgtgtacggtgggaggcctatataagcagagctcgtttagtgaaccgtcagatcgcctcgagtacgactcactataggatccaattcgacccaagtttgtacaaaaaagcaggctgattaccggtcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagatgagcggccgcaaaaagcactctgatttgacaattaaagcactctgatttgacaattaaagcactctgatttgacaattaaagcactctgatttgacaattaaagcttcgaattctgcagtcgacggtaccgcgggcccgggatccaccggatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgaattcccttatgtgagtgtaaaaggcaggcgagtttgtcccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 28 - DNA, 7277 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagataagaataaatatagaattctaggcgtgtacggtgggaggcctatataagcagagctcgtttagtgaaccgtcagatcgcctcgagtaagaataaatataggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 29 - DNA, 7277 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagataccactcactatagaattctaggcgtgtacggtgggaggcctatataagcagagctcgtttagtgaaccgtcagatcgcctcgagtaccactcactataggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 30 - DNA, 7285 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatactgaataatcaacactgaattctaggcgtgtacggtgggaggcctatataagcagagctcgtttagtgaaccgtcagatcgcctcgagtactgaataatcaacactggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 31 - DNA, 7291 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatatagaaccgatcctcccattgaattctaggcgtgtacggtgggaggcctatataagcagagctcgtttagtgaaccgtcagatcgcctcgagtatagaaccgatcctcccattggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 32 - DNA, 7289 bp, Artificial Sequence
  plasmid construct
gatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgaattcccttatgtgagtgtaaaaggcaggcgagtttgtcccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagagccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtctaatacccaatctctcgtcttatccagatgttttatacgccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacctcatcaggaacatgttgaattctaggcgtgtacggtgggaggcctatataagcagagctcgtttagtgaaccgtcagatcgcctcgagtacctcatcaggaacatgttg

SEQ ID NO: 33 - DNA, 7289 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatctttgaaagccccgccactgaattctaggcgtgtacggtgggaggcctatataagcagagctcgtttagtgaaccgtcagatcgcctcgagtctttgaaagccccgccactggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 34 - DNA, 7285 bp, Artificial Sequence
  plasmid construct
gatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgaattcccttatgtgagtgtaaaaggcaggcgagtttgtcccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagagccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtctaatacccaatctctcgtcttatccagatgttttatacgccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatatttcgacgctcattctgaattctaggcgtgtacggtgggaggcctatataagcagagctcgtttagtgaaccgtcagatcgcctcgagtatttcgacgctcattctg

SEQ ID NO: 35 - DNA, 7283 bp, Artificial Sequence
  plasmid construct
gatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgaattcccttatgtgagtgtaaaaggcaggcgagtttgtcccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagagccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtctaatacccaatctctcgtcttatccagatgttttatacgccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatcccggaagccgatgctgaattctaggcgtgtacggtgggaggcctatataagcagagctcgtttagtgaaccgtcagatcgcctcgagtcccggaagccgatgctg

SEQ ID NO: 36 - DNA, 7283 bp, Artificial Sequence
  plasmid construct
gatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgaattcccttatgtgagtgtaaaaggcaggcgagtttgtcccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagagccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtctaatacccaatctctcgtcttatccagatgttttatacgccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacccctctccgcttctgaattctaggcgtgtacggtgggaggcctatataagcagagctcgtttagtgaaccgtcagatcgcctcgagtacccctctccgcttctg

SEQ ID NO: 37 - DNA, 7299 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatcctgaccattcatcagccgtctatgaattctaggcgtgtacggtgggaggcctatataagcagagctcgtttagtgaaccgtcagatcgcctcgagtcctgaccattcatcagccgtctatggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 38 - DNA, 7299 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatgccctcggccatcagaaggatcttgaattctaggcgtgtacggtgggaggcctatataagcagagctcgtttagtgaaccgtcagatcgcctcgagtgccctcggccatcagaaggatcttggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 39 - DNA, 7299 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatattattggccttaaccatactcttgaattctaggcgtgtacggtgggaggcctatataagcagagctcgtttagtgaaccgtcagatcgcctcgagtattattggccttaaccatactcttggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 40 - DNA, 7299 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatccatgtaaaacatttttctgacatgaattctaggcgtgtacggtgggaggcctatataagcagagctcgtttagtgaaccgtcagatcgcctcgagtccatgtaaaacatttttctgacatggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 41 - DNA, 7287 bp, Artificial Sequence
  plasmid construct
gatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgaattcccttatgtgagtgtaaaaggcaggcgagtttgtcccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagagccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtctaatacccaatctctcgtcttatccagatgttttatacgccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatccatctcctcaaggatgtgaattctaggcgtgtacggtgggaggcctatataagcagagctcgtttagtgaaccgtcagatcgcctcgagtccatctcctcaaggatgtg

SEQ ID NO: 42 - DNA, 7299 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatctagactcttcacaatgttcttatgaattctaggcgtgtacggtgggaggcctatataagcagagctcgtttagtgaaccgtcagatcgcctcgagtctagactcttcacaatgttcttatggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 43 - DNA, 7287 bp, Artificial Sequence
  plasmid construct
gatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgaattcccttatgtgagtgtaaaaggcaggcgagtttgtcccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagagccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtctaatacccaatctctcgtcttatccagatgttttatacgccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatgtcgtcttctgcacttatgaattctaggcgtgtacggtgggaggcctatataagcagagctcgtttagtgaaccgtcagatcgcctcgagtgtcgtcttctgcacttatg

SEQ ID NO: 44 - DNA, 7287 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatagtcagcaccaggcatttgaattctaggcgtgtacggtgggaggcctatataagcagagctcgtttagtgaaccgtcagatcgcctcgagtagtcagcaccaggcatttggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 45 - DNA, 7287 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatccggatgctcctcttaatgaattctaggcgtgtacggtgggaggcctatataagcagagctcgtttagtgaaccgtcagatcgcctcgagtccggatgctcctcttaatggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 46 - DNA, 7287 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatagacaaaccacaactcttgaattctaggcgtgtacggtgggaggcctatataagcagagctcgtttagtgaaccgtcagatcgcctcgagtagacaaaccacaactcttggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 47 - DNA, 7285 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatggtagaccttagggctagaattctaggcgtgtacggtgggaggcctatataagcagagctcgtttagtgaaccgtcagatcgcctcgagtggtagaccttagggctaggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 48 - DNA, 7277 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatccgcctccctctcgaattctaggcgtgtacggtgggaggcctatataagcagagctcgtttagtgaaccgtcagatcgcctcgagtccgcctccctctcggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 49 - DNA, 7277 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatatgatttattatagaattctaggcgtgtacggtgggaggcctatataagcagagctcgtttagtgaaccgtcagatcgcctcgagtatgatttattataggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 50 - DNA, 7275 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagataggagtgagtatgaattctaggcgtgtacggtgggaggcctatataagcagagctcgtttagtgaaccgtcagatcgcctcgagtaggagtgagtatggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 51 - DNA, 7277 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacaacacactatagaattctaggcgtgtacggtgggaggcctatataagcagagctcgtttagtgaaccgtcagatcgcctcgagtacaacacactataggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 52 - DNA, 7277 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatttattccctgacagaattctaggcgtgtacggtgggaggcctatataagcagagctcgtttagtgaaccgtcagatcgcctcgagtttattccctgacaggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 53 - DNA, 9066 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaattcgcccttattaattggctccggtgcccgtcagtgggcagagcgcacatcgcccacagtccccgagaagttgtggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtggatcccaagggcgaattcgacccaagtttgtacaaaaaagcaggctgattaccggtcgccaccatgagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacggatctggcgccaccaacttctctctgctgaagcaggccggcgacgtggaggagaacccaggcccatctagaatggcccccccgaccgatgtcagcctgggggacgagctccacttagacggcgaggacgtggcgatggcgcatgccgacgcgctagacgatttcgatctggacatgttgggggacggggattccccgggtccgggatttaccccccacgactccgccccctacggcgctctggatatggccgacttcgagtttgagcagatgtttaccgatgcccttggaattgacgagtacggtgggacgcgtatgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattatttgtacaagataatgtgaataaagatgccgtcacagatagattggcttcagtggagactgatatgcctctaacattgagacagcatagaataagtgcgacatcatcatcggaagagagtagtaacaaaggtcaaagacagttgactgtataagcggccgcaaaaagcactctgatttgacaattaaagcactctgatttgacaattaaagcactctgatttgacaattaaagcactctgatttgacaattaaagcttcgaattctgcagtcgacggtaccgcgggcccgggatccaccggatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 54 - DNA, 3727 bp, Artificial Sequence
  plasmid construct
tgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggacatgtgattacgccaagctacgggcggagtactgtcctccgagcggagtactgtcctccgagcggagtactgtcctccgagcggagtactgtcctccgagcggagttctgtcctccgagcggagactctagatacgactcactatagaattctaggcgtgtacggtgggaggcctatataagcagagctcgtttagtgaaccgtcagatcgcctcgagtacgactcactatagctagcaccggtcgccaccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccgcaaaaagcactctgatttgacaattaaagcactctgatttgacaattaaagcactctgatttgacaattaaagcactctgatttgacaattaaagcttgtcgacggtaccgcgggcccgggatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgt

SEQ ID NO: 55 - DNA, 3727 bp, Artificial Sequence
  plasmid construct
tgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggacatgtgattacgccaagctacgggcggagtactgtcctccgagcggagtactgtcctccgagcggagtactgtcctccgagcggagtactgtcctccgagcggagttctgtcctccgagcggagactctagatacgactcactatagaattctaggcgtgtacggtgggaggcctatataagcagagctcgtttagtgaaccgtcagatcgcctcgagtaagaataaatatagctagcaccggtcgccaccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccgcaaaaagcactctgatttgacaattaaagcactctgatttgacaattaaagcactctgatttgacaattaaagcactctgatttgacaattaaagcttgtcgacggtaccgcgggcccgggatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgt

SEQ ID NO: 56 - DNA, 3727 bp, Artificial Sequence
  plasmid construct
tgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggacatgtgattacgccaagctacgggcggagtactgtcctccgagcggagtactgtcctccgagcggagtactgtcctccgagcggagtactgtcctccgagcggagttctgtcctccgagcggagactctagataagaataaatatagaattctaggcgtgtacggtgggaggcctatataagcagagctcgtttagtgaaccgtcagatcgcctcgagtacgactcactatagctagcaccggtcgccaccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccgcaaaaagcactctgatttgacaattaaagcactctgatttgacaattaaagcactctgatttgacaattaaagcactctgatttgacaattaaagcttgtcgacggtaccgcgggcccgggatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgt

SEQ ID NO: 57 - DNA, 3727 bp, Artificial Sequence
  plasmid construct
tgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggacatgtgattacgccaagctacgggcggagtactgtcctccgagcggagtactgtcctccgagcggagtactgtcctccgagcggagtactgtcctccgagcggagttctgtcctccgagcggagactctagataagaataaatatagaattctaggcgtgtacggtgggaggcctatataagcagagctcgtttagtgaaccgtcagatcgcctcgagtaagaataaatatagctagcaccggtcgccaccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccgcaaaaagcactctgatttgacaattaaagcactctgatttgacaattaaagcactctgatttgacaattaaagcactctgatttgacaattaaagcttgtcgacggtaccgcgggcccgggatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgt

SEQ ID NO: 58 - DNA, 7370 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtttaccgagctcttattggttttcaaacttcattgactgtgccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacgactcactatagaattctaggcgtgtacggtgggaggcctatataagcagagctcgtttagtgaaccgtcagatcgcctcgagtacgactcactataggatccaattcgacccaagtttgtacaaaaaagcaggctgattaccggtcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagatgagcggccgcaaaaagcactctgatttgacaattaaagcactctgatttgacaattaaagcactctgatttgacaattaaagcactctgatttgacaattaaagcttcgaattctgcagtcgacggtaccgcgggcccgggatccaccggatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgcgtttttatgcttgtagtattgtataatgtttttaagatccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 59 - DNA, 7283 bp, Artificial Sequence
  plasmid construct
aattctaggcgtgtacggtgggaggcctatataagcagagctcgtttagtgaaccgtcagatcgcctcgagtaggtttacgactcactataggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgaattcccttatgtgagtgtaaaaggcaggcgagtttgtcccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagagccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtctaatacccaatctctcgtcttatccagatgttttatacgccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacgactcactatag

SEQ ID NO: 60 - DNA, 7288 bp, Artificial Sequence
  plasmid construct
aattctaggcgtgtacggtgggaggcctatataagcagagctcgtttagtgaaccgtcagatcgcctcgagtaggttgtgtctacgactcactataggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgaattcccttatgtgagtgtaaaaggcaggcgagtttgtcccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagagccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtctaatacccaatctctcgtcttatccagatgttttatacgccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacgactcactatag

SEQ ID NO: 61 - DNA, 7294 bp, Artificial Sequence
  plasmid construct
aattctaggcgtgtacggtgggaggcctatataagcagagctcgtttagtgaaccgtcagatcgcctcgagtaggttgtgtcgcgagttacgactcactataggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgaattcccttatgtgagtgtaaaaggcaggcgagtttgtcccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagagccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtctaatacccaatctctcgtcttatccagatgttttatacgccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacgactcactatag

SEQ ID NO: 62 - DNA, 7299 bp, Artificial Sequence
  plasmid construct
aattctaggcgtgtacggtgggaggcctatataagcagagctcgtttagtgaaccgtcagatcgcctcgagtaggttgtgtcgcgagtgttggtacgactcactataggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgaattcccttatgtgagtgtaaaaggcaggcgagtttgtcccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagagccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtctaatacccaatctctcgtcttatccagatgttttatacgccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacgactcactatag

SEQ ID NO: 63 - DNA, 7305 bp, Artificial Sequence
  plasmid construct
ctagatacgactcactatagaattctaggcgtgtacggtgggaggcctatataagcagagctcgtttagtgaaccgtcagatcgcctcgagtaggttgtgtcgcgagtgttggttcgagtacgactcactataggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgaattcccttatgtgagtgtaaaaggcaggcgagtttgtcccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagagccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtctaatacccaatctctcgtcttatccagatgttttatacgccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagact

SEQ ID NO: 64 - DNA, 7277 bp, Artificial Sequence; identical to SEQ ID NO: 28
  plasmid construct

SEQ ID NO: 65 - DNA, 7310 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagataagaataaatatagaattctaggcgtgtacggtgggaggcctatataagcagagctcgtttagtgaaccgtcagatcgcctcgagtaagaataaatatacctaagaataaatatacgtaagaataaatatagggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 66 - DNA, 7277 bp, Artificial Sequence; identical to SEQ ID NO: 29
  plasmid construct

SEQ ID NO: 67 - DNA, 7305 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagataccactcactatagaattctaggcgtgtacggtgggaggcctatataagcagagctcgtttagtgaaccgtcagatcgcctcgagtaccactcactatataccactcactatataccactcactataggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 68 - DNA, 7285 bp, Artificial Sequence; identical to SEQ ID NO: 30
  plasmid construct

SEQ ID NO: 69 - DNA, 7321 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatactgaataatcaacactgaattctaggcgtgtacggtgggaggcctatataagcagagctcgtttagtgaaccgtcagatcgcctcgagtactgaataatcaacacttactgaataatcaacacttactgaataatcaacactggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 70 - DNA, 7277 bp, Artificial Sequence; identical to SEQ ID NO: 51
  plasmid construct

SEQ ID NO: 71 - DNA, 7305 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacaacacactatagaattctaggcgtgtacggtgggaggcctatataagcagagctcgtttagtgaaccgtcagatcgcctcgagtacaacacactatatacaacacactatatacaacacactataggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 72 - DNA, 21225 bp, Artificial Sequence
  plasmid construct
caattgaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgtatcgatgtcgacgttaacgctagtgatatcaactttgtatagaaaagttggctccgaatttctcgagggcttgtcgacgacggcggtctccgtcgtcaggatcatgaattcgaccccaagtttgtacaaaaaagcagacggcctgccaccatgaccgagtacaagcccacggtgcgcctcgccacccgcgacgacgtcccccgggccgtacgcaccctcgccgccgcgttcgccgactaccccgccacgcgccacaccgtcgacccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgatacccagctttcttgtacaaagttggcattataagaaagcattgcttatcaatttgttgcaacgaacaggtcactatcagtcaaaataaaatcattatttacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttgaattctctagaattaccctgttatccctaggtttaccgagctcttattggttttcaaacttcattgactgtgccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgatcaactttgtatagaaaagttggctccgaattcgcccttcaggtccgaggttctagacgagtttactccctatcagtgatagagaacgatgtcgagtttactccctatcagtgatagagaacgtatgtcgagtttactccctatcagtgatagagaacgtatgtcgagtttactccctatcagtgatagagaacgtatgtcgagtttatccctatcagtgatagagaacgtatgtcgagtttactccctatcagtgatagagaacgtatgtcgaggtaggcgtgtacggtgggaggcctatataagcagagctcgtttagtgaaccgtcagatcgcaaagggcgaattcgacccaagtttgtacaaaaaagcaggctgattaccggagaattccaattgaccatgaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagggcccggcgcgcctaaggtacccccgggtaactgaaaatccaccggatctagataactgatctaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacccctctccgcttctgaattctaggcgtgtacggtgggaggcctatataagcagagctcgtttagtgaaccgtcagatcgcctcgagtacccctctccgcttcttacccctctccgcttcttacccctctccgcttctggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgatcaactttgtatagaaaagttggctccgaattcgcccttcaggtccgaggttctagacgagtttactccctatcagtgatagagaacgatgtcgagtttactccctatcagtgatagagaacgtatgtcgagtttactccctatcagtgatagagaacgtatgtcgagtttactccctatcagtgatagagaacgtatgtcgagtttatccctatcagtgatagagaacgtatgtcgagtttactccctatcagtgatagagaacgtatgtcgaggtaggcgtgtacggtgggaggcctatataagcagagctcgtttagtgaaccgtcagatcgcaaagggcgaattcgacccaagtttgtacaaaaaagcagatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaaacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgaattcccttatgtgagtgtaaaaggcaggcgagtttgtcccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgatcaactttgtatagaaaagttggctccgaattcgcccttgacagcagagatccagtttggttaattaattggctccggtgcccgtcagtgggcagagcgcacatcgcccacagtccccgagaagttggtgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagaagggcgaattcgacccaagtttgtacaaaaaagcaggctggatccccgggtaccggtcgccaccatggcccccccgaccgatgtcagcctgggggacgagctccacttagacggcgaggacgtggcgatggcgcatgccgacgcgctagacgatttcgatctggacatgttgggggacggggattccccgggtccgggatttaccccccacgactccgccccctacggcgctctggatatggccgacttcgagtttgagcagatgtttaccgatgcccttggaattgacgagtacggtgggacgcgtatgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattatttgtacaagataatgtgaataaagatgccgtcacagatagattggcttcagtggagactgatatgcctctaacattgagacagcatagaataagtgcgacatcatcatcggaagagagtagtaacaaaggtcaaagacagttgactgtagggtccggagccaccaacttctctctgctgaagcaggccggcgacgtggaggagaacccaggcccaactagtatgtctaggctggacaagagcaaagtcataaacggagctctggaattactcaatggtgtcggtatcgaaggcctgacgacaaggaaactcgctcaaaagctgggagttgagcagcctaccctgtactggcacgtgaagaacaagcgggccctgctcgatgccctgccaatcgagatgctggacaggcatcatacccacttctgccccctggaaggcgagtcatggcaagactttctgcggaacaacgccaagtcataccgctgtgctctcctctcacatcgcgacggggctaaagtgcatctcggcacccgcccaacagagaaacagtacgaaaccctggaaaatcagctcgcgttcctgtgtcagcaaggcttctccctggagaacgcactgtacgctctgtccgccgtgggccactttacactgggctgcgtattggaggaacaggagcatcaagtagcaaaagaggaaagagagacacctaccaccgattctatgcccccacttctgagacaagcaattgagctgttcgaccggcagggagccgaacctgccttccttttcggcctggaactaatcatatgtggcctggagaaacagctaaagtgcgaaagcggcgggccgaccgacgcccttgacgattttgacttagacatgctcccagccgatgcccttgacgattttgaccttgacatgctccccgggcaattggagggccgcggcagcctgctgacctgcggcgacgtggaggaaaaccccggccccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaaataccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggttgcttgcaaaagcagtaattggaaagcactctcaaagaatccgttgcttgcaaaagcagtaattggaaagcactctcaaagaatcccaattgcatcgatggtaccagtgaaagtctgcaatgaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacggcaacgaacagggtcgacggtgcgtttttatgcttgtagtattgtataatgtttttaagatcctagggataacagggtaatcggccgctatttgaacattagcggccgctaccgcgggagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagacggtatcactagtattacagaggtaagttataacagtcgcctaacc

SEQ ID NO: 73 - DNA, 9636 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgagttaattaatagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttgttgtgctgtctcatcattttggcaaagaattcgacccaagtttgtacaaaaaagcaggctgattaccggtaccatgtctagactggacaagagcaaagtcataaacggcgctctggaattactcaatggagtcggtatcgaaggcctgacgacaaggaaactcgctcaaaagctgggagttgagcagcctaccctgtactggcacgtgaagaacaagcgggccctgctcgatgccctgccaatcgagatgctggacaggcatcatacccacttctgccccctggaaggcgagtcatggcaagactttctgcggaacaacgccaagtcattccgctgtgctctcctctcacatcgcgacggggctaaagtgcatctcggcacccgcccaacagagaaacagtacgaaaccctggaaaatcagctcgcgttcctgtgtcagcaaggcttctccctggagaacgcactgtacgctctgtccgccgtgggccactttacactgggctgcgtattggaggaacaggagcatcaagtagcaaaagaggaaagagagacacctaccaccgattctatgcccccacttctgagacaagcaattgagctgttcgaccggcagggagccgaacctgccttccttttcggcctggaactaatcatatgtggcctggagaaacagctaaagtgcgaaagcggcgggccggccgacgcccttgacgattttgacttagacatgctcccagccgatgcccttgacgactttgaccttgatatgctgcctgctgacgctcttgacgattttgaccttgacatgctccccgggggatctggcgccaccaacttctctctgctgaagcaggccggcgacgtggaggagaacccaggcccaactagaatggcccccccgaccgatgtcagcctgggggacgagctccacttagacggcgaggacgtggcgatggcgcatgccgacgcgctagacgatttcgatctggacatgttgggggacggggattccccgggtccgggatttaccccccacgactccgccccctacggcgctctggatatggccgacttcgagtttgagcagatgtttaccgatgcccttggaattgacgagtacggtgggacgcgtatgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattatttgtacaagataatgtgaataaagatgccgtcacagatagattggcttcagtggagactgatatgcctctaacattgagacagcatagaataagtgcgacatcatcatcggaagagagtagtaacaaaggtcaaagacagttgactgtataagcggccgcaaaaagcactctgatttgacaattaaagcactctgatttgacaattaaagcactctgatttgacaattaaagcactctgatttgacaattaaagcttcgaattctgcagtcgacggtaccgcgggcccgggatccaccggatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 74 - DNA, 7301 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtttaccgagctcttattggttttcaaacttcattgactgtgccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacccctctccgcttctgaattctaggcgtgtacggtgggaggcctatataagcagagctcgtttagtgaaccgtcagatcgcctcgagtacccctctccgcttctggatccaattcgacccaagtttgtacaaaaaagcaggctgattaccggtcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagatgagcggccgcctcagatctcgagctcaagcttcgaattctgcagtcgacggtaccgcgggcccgggatccaccggatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgcgtttttatgcttgtagtattgtataatgtttttaagatccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 75 - DNA, 7317 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacccctctccgcttctgaattctaggcgtgtacggtgggaggcctatataagcagagctcgtttagtgaaccgtcagatcgcctcgagtacccctctccgcttcttacccctctccgcttcttacccctctccgcttctggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 76 - DNA, 7305 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtttaccgagctcttattggttttcaaacttcattgactgtgccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatgtcgtcttctgcacttatgaattctaggcgtgtacggtgggaggcctatataagcagagctcgtttagtgaaccgtcagatcgcctcgagtgtcgtcttctgcacttatggatccaattcgacccaagtttgtacaaaaaagcaggctgattaccggtcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagatgagcggccgcctcagatctcgagctcaagcttcgaattctgcagtcgacggtaccgcgggcccgggatccaccggatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgcgtttttatgcttgtagtattgtataatgtttttaagatccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 77 - DNA, 7325 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatgtcgtcttctgcacttatgaattctaggcgtgtacggtgggaggcctatataagcagagctcgtttagtgaaccgtcagatcgcctcgagtgtcgtcttctgcacttattgtcgtcttctgcacttattgtcgtcttctgcacttatggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 78 - DNA, 7352 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgagtttactccctatcagtgatagagaacgtatgtcgagtttactccctatcagtgatagagaacgatgtcgagtttactccctatcagtgatagagaacgtatgtcgagtttactccctatcagtgatagagaacgtatgtcgagtttactccctatcagtgatagagaacgtatgtcgagtttatccctatcagtgatagagaacgtatgtcgagtttactccctatcagtgatagagaacgtatgtcgaggtaggcgtgtacggtgggaggcctatataagcagagctcgtttagtgaaccgtcagatcgcctggagatttcgagctcggtacccggggatcctctagtcagctgacgcgtgctagtggcgcgccgaattcgacccaagtttgtacaaaaaagcaggctcgccaccatggtgagcaagggcgaggagctgttcaccggggtggtgcccatcctggtcgagctggacggcgacgtaaacggccacaagttcagcgtgaggggcgagggcgagggcgatgccaccaacggcaagctgaccctgaagttcatctgcaccaccggcaagctgcccgtgccctggcccaccctcgtgaccaccctgagccacggcgtgcagtgcttcgcccgctaccccgaccacatgaagcagcacgacttcttcaagtccgccatgcccgaaggctacgtccaggagcgcaccatcttcttcaaggacgacggcacctacaagacccgcgccgaggtgaagttcgagggcgacaccctagtgaaccgcatcgagctgaagggcgtcgacttcaaggaggacggcaacatcctggggcacaagctggagtacaacttcaacagccacaacatctatatcatggccgtcaagcagaagaacggcatcaaggtgaacttcaagatccgccacaacgtggaggacggcagcgtgcagctcgccgaccactaccagcagaacacccccatcggcgacggccccgtgctgctgcccgacagccactacctgagcacccagtccgtgctgagcaaagaccccaacgagaagcgcgatcacatggtcctgctggagttccgcaccgccgccgggatcactctcggcatggacgagctgtacaagtaataccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 79 - DNA, 9919 bp, Artificial Sequence
  plasmid construct
caactttgtatagaaaagttggctccgaattcgcccttcaggtccgaggttctagacgagtttactccctatcagtgatagagaacgatgtcgagtttactccctatcagtgatagagaacgtatgtcgagtttactccctatcagtgatagagaacgtatgtcgagtttactccctatcagtgatagagaacgtatgtcgagtttatccctatcagtgatagagaacgtatgtcgagtttactccctatcagtgatagagaacgtatgtcgaggtaggcgtgtacggtgggaggcctatataagcagagctcgtttagtgaaccgtcagatcgcaaagggcgaattcgacccaagtttgtacaaaaaagcaggctgattaccggagaattcgtgagcaagggcgccaccatgaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttactagttaagtcgacggtaccccgcttgaagtctttaattaaaccgcttgaagtctttaattaaaccgcttgaagtctttaattaaacccgggccgcttgaagtctttaattaaagtctagataactgatctaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgcgtttttatgcttgtagtattgtataatgtttttaagatccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtttaccgagctcttattggttttcaaacttcattgactgtgccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 80 - DNA, 10140 bp, Artificial Sequence
  plasmid construct
caactttgtatagaaaagttggctccgaattcgcccttcaggtccgaggttctagacgagtttactccctatcagtgatagagaacgatgtcgagtttactccctatcagtgatagagaacgtatgtcgagtttactccctatcagtgatagagaacgtatgtcgagtttactccctatcagtgatagagaacgtatgtcgagtttatccctatcagtgatagagaacgtatgtcgagtttactccctatcagtgatagagaacgtatgtcgaggtaggcgtgtacggtgggaggcctatataagcagagctcgtttagtgaaccgtcagatcgcaaagggcgaattcgacccaagtttgtacaaaaaagcaggctgattaccggagaattcgtgagcaagggcgccaccatgaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttactagttaagcggccgcaaacgatatgggctgaatacaataccaaacgatatgggctgaatacaataccaaacgatatgggctgaatacaataccaaacgatatgggctgaatacaatacaagcttgaggtgatctagataactgatctaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgcgtttttatgcttgtagtattgtataatgtttttaagatccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtttaccgagctcttattggttttcaaacttcattgactgtgccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 81 - DNA, 10089 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacccctctccgcttctgaattctaggcgtgtacggtgggaggcctatataagcagagctcgtttagtgaaccgtcagatcgcctcgagtacccctctccgcttctggatccaattcgacccaagtttgtacaaaaaagcaggctgattaccggagaattcgtgagcaagggcgccaccatgaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttactagttaagcggccgcaaacgatatgggctgaatacaataccaaacgatatgggctgaatacaataccaaacgatatgggctgaatacaataccaaacgatatgggctgaatacaatacaagcttgaggtgatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 82 - DNA, 10123 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacccctctccgcttctgaattctaggcgtgtacggtgggaggcctatataagcagagctcgtttagtgaaccgtcagatcgcctcgagtacccctctccgcttcttacccctctccgcttcttacccctctccgcttctggatccaattcgacccaagtttgtacaaaaaagcaggctgattaccggagaattcgtgagcaagggcgccaccatgaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttactagttaagcggccgcaaacgatatgggctgaatacaataccaaacgatatgggctgaatacaataccaaacgatatgggctgaatacaataccaaacgatatgggctgaatacaatacaagcttgaggtgatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 83 - DNA, 9872 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatgtcgtcttctgcacttatgaattctaggcgtgtacggtgggaggcctatataagcagagctcgtttagtgaaccgtcagatcgcctcgagtgtcgtcttctgcacttatggatccaattcgacccaagtttgtacaaaaaagcaggctgattaccggagaattcgtgagcaagggcgccaccatgaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttactagttaagtcgacggtaccccgcttgaagtctttaattaaaccgcttgaagtctttaattaaaccgcttgaagtctttaattaaacccgggccgcttgaagtctttaattaaagtctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 84 - DNA, 9910 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatgtcgtcttctgcacttatgaattctaggcgtgtacggtgggaggcctatataagcagagctcgtttagtgaaccgtcagatcgcctcgagtgtcgtcttctgcacttattgtcgtcttctgcacttattgtcgtcttctgcacttatggatccaattcgacccaagtttgtacaaaaaagcaggctgattaccggagaattcgtgagcaagggcgccaccatgaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttactagttaagtcgacggtaccccgcttgaagtctttaattaaaccgcttgaagtctttaattaaaccgcttgaagtctttaattaaacccgggccgcttgaagtctttaattaaagtctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 85 - DNA, 6371 bp, Artificial Sequence
  plasmid construct
ctctagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaaggcgtaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtcctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccctagggggaggctaactgaaacacggaaggagacaataccggaaggaacccgcgctatgacggcaataaaaagacagaataaaacgcacggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcctcaggttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtatttaattaatagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttgttgtgctgtctcatcattttggcaaagaattcggccattacggccgctagcttaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagtaagcggccgcaaagcttcgaattctgcagtcgacggtaccgcgggcccgggatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgttcgaccgaataaaacctgtgacggaagatcacttcgcagaataaataaatcctggtgtccctgttgataccggagatctcccacgccctgaagctgaaggacggcggccactacacctgcgacttcaagaccgtgtacaaggccaagaagcccgtgcagctgcccggcaaccactacgtggactccaagctggacatcaccaaccacaacgaggactacaccgtggtggagcagtacgagcacgccgaggcccgccactccggctcccagtagagcggccgcga

SEQ ID NO: 86 - DNA, 8833 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtctaatacccaatctctcgtcttatccagatgttttatacgccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgagttaattaatagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttgttgtgctgtctcatcattttggcaaagaattcgacccaagtttgtacaaaaaagcaggctgattaccggtcgccaccatgagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcactaagcggccgcaaaaagcactctgatttgacaattaaagcactctgatttgacaattaaagcactctgatttgacaattaaagcactctgatttgacaattaaagcttcgaattctgcagtcgacggtaccgcgggcccgggatccaccggatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgaattcccttatgtgagtgtaaaaggcaggcgagtttgtcccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 87 - DNA, 7502 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgagtttactccctatcagtgatagagaacgtatgtcgagtttactccctatcagtgatagagaacgatgtcgagtttactccctatcagtgatagagaacgtatgtcgagtttactccctatcagtgatagagaacgtatgtcgagtttactccctatcagtgatagagaacgtatgtcgagtttatccctatcagtgatagagaacgtatgtcgagtttactccctatcagtgatagagaacgtatgtcgaggtaggcgtgtacggtgggaggcctatataagcagagctcgtttagtgaaccgtcagatcgcctggagatttcgagctcggtacccggggatcctctagtcagctgacgcgtgctagtggcgcgccgaattcgacccaagtttgtacaaaaaagcaggctgattaccggtcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagatgagcggccgcaaaaagcactctgatttgacaattaaagcactctgatttgacaattaaagcactctgatttgacaattaaagcactctgatttgacaattaaagcttcgaattctgcagtcgacggtaccgcgggcccgggatccaccggatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 88 - DNA, 9464 bp, Artificial Sequence
  plasmid construct
ttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgcgtttttatgcttgtagtattgtataatgtttttaagatccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtttaccgagctcttattggttttcaaacttcattgactgtgccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaattcgcccttattaattggctccggtgcccgtcagtgggcagagcgcacatcgcccacagtccccgagaagttgtggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtggatcccaagggcgaattcgacccaagtttgtacaaaaaagcaggctgattaccggtaccatgtctagactggacaagagcaaagtcataaacggcgctctggaattactcaatggagtcggtatcgaaggcctgacgacaaggaaactcgctcaaaagctgggagttgagcagcctaccctgtactggcacgtgaagaacaagcgggccctgctcgatgccctgccaatcgagatgctggacaggcatcatacccacttctgccccctggaaggcgagtcatggcaagactttctgcggaacaacgccaagtcattccgctgtgctctcctctcacatcgcgacggggctaaagtgcatctcggcacccgcccaacagagaaacagtacgaaaccctggaaaatcagctcgcgttcctgtgtcagcaaggcttctccctggagaacgcactgtacgctctgtccgccgtgggccactttacactgggctgcgtattggaggaacaggagcatcaagtagcaaaagaggaaagagagacacctaccaccgattctatgcccccacttctgagacaagcaattgagctgttcgaccggcagggagccgaacctgccttccttttcggcctggaactaatcatatgtggcctggagaaacagctaaagtgcgaaagcggcgggccggccgacgcccttgacgattttgacttagacatgctcccagccgatgcccttgacgactttgaccttgatatgctgcctgctgacgctcttgacgattttgaccttgacatgctccccgggggatctggcgccaccaacttctctctgctgaagcaggccggcgacgtggaggagaacccaggcccaactagtgctagaatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaataggcggccgcaaaaagcactctgatttgacaattaaagcactctgatttgacaattaaagcactctgatttgacaattaaagcactctgatttgacaattaaagcttcgaattctgcagtcgacggtaccgcgggcccgggatccaccggatctagataactgatctacccagctttc

SEQ ID NO: 89 - DNA, 10768 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgagtttactccctatcagtgatagagaacgtatgtcgagtttactccctatcagtgatagagaacgatgtcgagtttactccctatcagtgatagagaacgtatgtcgagtttactccctatcagtgatagagaacgtatgtcgagtttactccctatcagtgatagagaacgtatgtcgagtttatccctatcagtgatagagaacgtatgtcgagtttactccctatcagtgatagagaacgtatgtcgaggtaggcgtgtacggtgggaggcctatataagcagagctcgtttagtgaaccgtcagatcgcctggagatttcgagctcggtacccggggatcctctagtcagctgacgcgtgctagtggcgcgccgaattcgacccaagtttgtacaaaaaagcaggctgattaccggagaattcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagtcgacggtaccccgcttgaagtctttaattaaaccgcttgaagtctttaattaaaccgcttgaagtctttaattaaacccgggccgcttgaagtctttaattaaagtctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 90 - DNA, 10747 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgagtttactccctatcagtgatagagaacgtatgtcgagtttactccctatcagtgatagagaacgatgtcgagtttactccctatcagtgatagagaacgtatgtcgagtttactccctatcagtgatagagaacgtatgtcgagtttactccctatcagtgatagagaacgtatgtcgagtttatccctatcagtgatagagaacgtatgtcgagtttactccctatcagtgatagagaacgtatgtcgaggtaggcgtgtacggtgggaggcctatataagcagagctcgtttagtgaaccgtcagatcgcctggagatttcgagctcggtacccggggatcctctagtcagctgacgcgtgctagtggcgcgccgaattcgacccaagtttgtacaaaaaagcaggctgattaccggagaattcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagacaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagtcgacggtaccccgcttgaagtctttaattaaaccgcttgaagtctttaattaaaccgcttgaagtctttaattaaacccgggccgcttgaagtctttaattaaagtctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 91 - DNA, 9890 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtttaccgagctcttattggttttcaaacttcattgactgtgccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgagttaattaatagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttgttgtgctgtctcatcattttggcaaagaattcgacccaagtttgtacaaaaaagcaggctggatccccgggtaccggtcgccaccatggcccccccgaccgatgtcagcctgggggacgagctccacttagacggcgaggacgtggcgatggcgcatgccgacgcgctagacgatttcgatctggacatgttgggggacggggattccccgggtccgggatttaccccccacgactccgccccctacggcgctctggatatggccgacttcgagtttgagcagatgtttaccgatgcccttggaattgacgagtacggtgggacgcgtatgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattatttgtacaagataatgtgaataaagatgccgtcacagatagattggcttcagtggagactgatatgcctctaacattgagacagcatagaataagtgcgacatcatcatcggaagagagtagtaacaaaggtcaaagacagttgactgtagggtccggagctacaaatttttccctcctcaaacaggctggagatgtcgaagaaaatcctgggcctactagtatgagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcaccaattggagggccgcggcagcctgctgacctgcggcgacgtggaggaaaaccccggccccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaaataccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgcgtttttatgcttgtagtattgtataatgtttttaagatccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 92 - DNA, 7333 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatatagaaccgatcctcccattgaattctaggcgtgtacggtgggaggcctatataagcagagctcgtttagtgaaccgtcagatcgcctcgagtatagaaccgatcctcccatttatagaaccgatcctcccatttatagaaccgatcctcccattggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 93 - DNA, 7329 bp, Artificial Sequence
  plasmid construct
caactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacctcatcaggaacatgttgaattctaggcgtgtacggtgggaggcctatataagcagagctcgtttagtgaaccgtcagatcgcctcgagtacctcatcaggaacatgtttacctcatcaggaacatgtttacctcatcaggaacatgttggatccaattcgaccccaagtttgtacaaaaaagcagggatcccggtaccctcgacacctgctgacggagccaccatgcaccatcaccatcaccatatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagatgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagacactgtaccccgctgacggcggcctggaaggcagagccgacatggccctgaagctcgtgggcgggggccacctgatctgcaaccttaagaccacatacagatccaagaaacccgctaagaacctcaagatgcccggcgtctactatgtggacaggagactggaaagaatcaaggaggccgacaaagagacatacgtcgagcagcacgaggtggctgtggccagatactgcgacctccctagcaaactggggcacaaacttaattcctagtaacgctcagtgcaggtgaattctaccaccacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgattaacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggccatacatcgatacggtaccgagttggcgcgcctgggagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgcgcctggtggcgaacgat

SEQ ID NO: 94 - DNA, 7339 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatatttcgacgctcattctgaattctaggcgtgtacggtgggaggcctatataagcagagctcgtttagtgaaccgtcagatcgcctcgagtatttcgacgctcattcttatttcgacgctcattcttatttcgacgctcattctggatccaattcgacccaagtttgtacaaaaaagcaggctgattaccggtcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagatgagcggccgcctcagatctcgagctcaagcttcgaattctgcagtcgacggtaccgcgggcccgggatccaccggatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 95 - DNA, 11185 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgagtttactccctatcagtgatagagaacgtatgtcgagtttactccctatcagtgatagagaacgatgtcgagtttactccctatcagtgatagagaacgtatgtcgagtttactccctatcagtgatagagaacgtatgtcgagtttactccctatcagtgatagagaacgtatgtcgagtttatccctatcagtgatagagaacgtatgtcgagtttactccctatcagtgatagagaacgtatgtcgaggtaggcgtgtacggtgggaggcctatataagcagagctcgtttagtgaaccgtcagatcgcctggagatttcgagctcggtacccggggatcctctagtcagctgacgcgtgctagtggcgcgccgaattcgacccaagtttgtacaaaaaagcaggctgattaccggagaattcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagcggccgcaaaaagcactctgatttgacaattaaagcactctgatttgacaattaaagcactctgatttgacaattaaagcactctgatttgacaattaaagcttcgaattctgcatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 96 - DNA, 11062 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgagtttactccctatcagtgatagagaacgtatgtcgagtttactccctatcagtgatagagaacgatgtcgagtttactccctatcagtgatagagaacgtatgtcgagtttactccctatcagtgatagagaacgtatgtcgagtttactccctatcagtgatagagaacgtatgtcgagtttatccctatcagtgatagagaacgtatgtcgagtttactccctatcagtgatagagaacgtatgtcgaggtaggcgtgtacggtgggaggcctatataagcagagctcgtttagtgaaccgtcagatcgcctggagatttcgagctcggtacccggggatcctctagtcagctgacgcgtgctagtggcgcgccgaattcgacccaagtttgtacaaaaaagcaggctgattaccggagaattcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttactagttaagtcgacggtaccccgcttgaagtctttaattaaaccgcttgaagtctttaattaaaccgcttgaagtctttaattaaacccgggccgcttgaagtctttaattaaagtctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 97 - DNA, 10879 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgagtttactccctatcagtgatagagaacgtatgtcgagtttactccctatcagtgatagagaacgatgtcgagtttactccctatcagtgatagagaacgtatgtcgagtttactccctatcagtgatagagaacgtatgtcgagtttactccctatcagtgatagagaacgtatgtcgagtttatccctatcagtgatagagaacgtatgtcgagtttactccctatcagtgatagagaacgtatgtcgaggtaggcgtgtacggtgggaggcctatataagcagagctcgtttagtgaaccgtcagatcgcctggagatttcgagctcggtacccggggatcctctagtcagctgacgcgtgctagtggcgcgccgaattcgacccaagtttgtacaaaaaagcaggctgattaccggagaattcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagcggccgcaaaaagcactctgatttgacaattaaagcactctgatttgacaattaaagcactctgatttgacaattaaagcactctgatttgacaattaaagcttcgaattctgcatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 98 - DNA, 10981 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgagtttactccctatcagtgatagagaacgtatgtcgagtttactccctatcagtgatagagaacgatgtcgagtttactccctatcagtgatagagaacgtatgtcgagtttactccctatcagtgatagagaacgtatgtcgagtttactccctatcagtgatagagaacgtatgtcgagtttatccctatcagtgatagagaacgtatgtcgagtttactccctatcagtgatagagaacgtatgtcgaggtaggcgtgtacggtgggaggcctatataagcagagctcgtttagtgaaccgtcagatcgcctggagatttcgagctcggtacccggggatcctctagtcagctgacgcgtgctagtggcgcgccgaattcgacccaagtttgtacaaaaaagcaggctgattaccggagaattcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagcggccgcaaaaagcactctgatttgacaattaaagcactctgatttgacaattaaagcactctgatttgacaattaaagcactctgatttgacaattaaagcttcgaattctgcatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 99 - DNA, 10965 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtctaatacccaatctctcgtcttatccagatgttttatacgccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatatagaaccgatcctcccattgaattctaggcgtgtacggtgggaggcctatataagcagagctcgtttagtgaaccgtcagatcgcctcgagtatagaaccgatcctcccatttatagaaccgatcctcccatttatagaaccgatcctcccattggatccaattcgacccaagtttgtacaaaaaagcaggctgattaccggagaattcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagacaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttactagttaagtcgacggtaccccgcttgaagtctttaattaaaccgcttgaagtctttaattaaaccgcttgaagtctttaattaaacccgggccgcttgaagtctttaattaaagtctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgaattcccttatgtgagtgtaaaaggcaggcgagtttgtcccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 100 - DNA, 10772 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatatagaaccgatcctcccattgaattctaggcgtgtacggtgggaggcctatataagcagagctcgtttagtgaaccgtcagatcgcctcgagtatagaaccgatcctcccatttatagaaccgatcctcccatttatagaaccgatcctcccattggatccaattcgacccaagtttgtacaaaaaagcaggctgattaccggagaattcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagacaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaaggtaccaaccaaagagattcctcataaagtcaaaccaaagagattcctcataaagtcaaaccaaagagattcctcataaagtcaaaccaaagagattcctcataaagctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 101 - DNA, 10671 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtctaatacccaatctctcgtcttatccagatgttttatacgccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatatagaaccgatcctcccattgaattctaggcgtgtacggtgggaggcctatataagcagagctcgtttagtgaaccgtcagatcgcctcgagtatagaaccgatcctcccatttatagaaccgatcctcccatttatagaaccgatcctcccattggatccaattcgacccaagtttgtacaaaaaagcaggctgattaccggagaattcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagacaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagtcgacggtaccccgcttgaagtctttaattaaaccgcttgaagtctttaattaaaccgcttgaagtctttaattaaacccgggccgcttgaagtctttaattaaagtctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgaattcccttatgtgagtgtaaaaggcaggcgagtttgtcccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 102 - DNA, 10892 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatatagaaccgatcctcccattgaattctaggcgtgtacggtgggaggcctatataagcagagctcgtttagtgaaccgtcagatcgcctcgagtatagaaccgatcctcccatttatagaaccgatcctcccatttatagaaccgatcctcccattggatccaattcgacccaagtttgtacaaaaaagcaggctgattaccggagaattcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagacaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagcggccgcaaacgatatgggctgaatacaataccaaacgatatgggctgaatacaataccaaacgatatgggctgaatacaataccaaacgatatgggctgaatacaatacaagcttgaggtgatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 103 - DNA, 11105 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacctcatcaggaacatgttgaattctaggcgtgtacggtgggaggcctatataagcagagctcgtttagtgaaccgtcagatcgcctcgagtacctcatcaggaacatgtttacctcatcaggaacatgtttacctcatcaggaacatgttggatccaattcgacccaagtttgtacaaaaaagcaggctgattaccggagaattcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagcggccgcaaaaagcactctgatttgacaattaaagcactctgatttgacaattaaagcactctgatttgacaattaaagcactctgatttgacaattaaagcttcgaattctgcatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 104 - DNA, 10768 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacctcatcaggaacatgttgaattctaggcgtgtacggtgggaggcctatataagcagagctcgtttagtgaaccgtcagatcgcctcgagtacctcatcaggaacatgtttacctcatcaggaacatgtttacctcatcaggaacatgttggatccaattcgacccaagtttgtacaaaaaagcaggctgattaccggagaattcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagacaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaaggtaccaaccaaagagattcctcataaagtcaaaccaaagagattcctcataaagtcaaaccaaagagattcctcataaagtcaaaccaaagagattcctcataaagctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 105 - DNA, 10667 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacctcatcaggaacatgttgaattctaggcgtgtacggtgggaggcctatataagcagagctcgtttagtgaaccgtcagatcgcctcgagtacctcatcaggaacatgtttacctcatcaggaacatgtttacctcatcaggaacatgttggatccaattcgacccaagtttgtacaaaaaagcaggctgattaccggagaattcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagacaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagtcgacggtaccccgcttgaagtctttaattaaaccgcttgaagtctttaattaaaccgcttgaagtctttaattaaacccgggccgcttgaagtctttaattaaagtctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 106 - DNA, 10661 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacctcatcaggaacatgttgaattctaggcgtgtacggtgggaggcctatataagcagagctcgtttagtgaaccgtcagatcgcctcgagtacctcatcaggaacatgtttacctcatcaggaacatgtttacctcatcaggaacatgttggatccaattcgacccaagtttgtacaaaaaagcaggctgattaccggagaattcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagacaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagtcgacggtaccaagcactctgatttgacaattaaagcactctgatttgacaattaaagcactctgatttgacaattaaagcactctgatttgacaattaatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 107 - DNA, 10888 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacctcatcaggaacatgttgaattctaggcgtgtacggtgggaggcctatataagcagagctcgtttagtgaaccgtcagatcgcctcgagtacctcatcaggaacatgtttacctcatcaggaacatgtttacctcatcaggaacatgttggatccaattcgacccaagtttgtacaaaaaagcaggctgattaccggagaattcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagacaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagcggccgcaaacgatatgggctgaatacaataccaaacgatatgggctgaatacaataccaaacgatatgggctgaatacaataccaaacgatatgggctgaatacaatacaagcttgaggtgatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 108 - DNA, 11097 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgaattcccttatgtgagtgtaaaaggcaggcgagtttgtcccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatatttcgacgctcattctgaattctaggcgtgtacggtgggaggcctatataagcagagctcgtttagtgaaccgtcagatcgcctcgagtatttcgacgctcattcttatttcgacgctcattcttatttcgacgctcattctggatccaattcgacccaagtttgtacaaaaaagcaggctgattaccggagaattcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagcggccgcaaaaagcactctgatttgacaattaaagcactctgatttgacaattaaagcactctgatttgacaattaaagcactctgatttgacaattaaagcttcgaattctgcatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggttgcttgcaaaagcagtaattggaaagcactctcaaagaatccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 109 - DNA, 10974 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatatttcgacgctcattctgaattctaggcgtgtacggtgggaggcctatataagcagagctcgtttagtgaaccgtcagatcgcctcgagtatttcgacgctcattcttatttcgacgctcattcttatttcgacgctcattctggatccaattcgacccaagtttgtacaaaaaagcaggctgattaccggagaattcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttactagttaagtcgacggtaccccgcttgaagtctttaattaaaccgcttgaagtctttaattaaaccgcttgaagtctttaattaaacccgggccgcttgaagtctttaattaaagtctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 110 - DNA, 10659 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatatttcgacgctcattctgaattctaggcgtgtacggtgggaggcctatataagcagagctcgtttagtgaaccgtcagatcgcctcgagtatttcgacgctcattcttatttcgacgctcattcttatttcgacgctcattctggatccaattcgacccaagtttgtacaaaaaagcaggctgattaccggagaattcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagacaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagtcgacggtaccccgcttgaagtctttaattaaaccgcttgaagtctttaattaaaccgcttgaagtctttaattaaacccgggccgcttgaagtctttaattaaagtctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 111 - DNA, 10880 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatatttcgacgctcattctgaattctaggcgtgtacggtgggaggcctatataagcagagctcgtttagtgaaccgtcagatcgcctcgagtatttcgacgctcattcttatttcgacgctcattcttatttcgacgctcattctggatccaattcgacccaagtttgtacaaaaaagcaggctgattaccggagaattcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagacaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagcggccgcaaacgatatgggctgaatacaataccaaacgatatgggctgaatacaataccaaacgatatgggctgaatacaataccaaacgatatgggctgaatacaatacaagcttgaggtgatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 112 - DNA, 11093 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgaattcccttatgtgagtgtaaaaggcaggcgagtttgtcccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacccctctccgcttctgaattctaggcgtgtacggtgggaggcctatataagcagagctcgtttagtgaaccgtcagatcgcctcgagtacccctctccgcttcttacccctctccgcttcttacccctctccgcttctggatccaattcgacccaagtttgtacaaaaaagcaggctgattaccggagaattcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagcggccgcaaaaagcactctgatttgacaattaaagcactctgatttgacaattaaagcactctgatttgacaattaaagcactctgatttgacaattaaagcttcgaattctgcatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggttgcttgcaaaagcagtaattggaaagcactctcaaagaatccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 113 - DNA, 10787 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacccctctccgcttctgaattctaggcgtgtacggtgggaggcctatataagcagagctcgtttagtgaaccgtcagatcgcctcgagtacccctctccgcttcttacccctctccgcttcttacccctctccgcttctggatccaattcgacccaagtttgtacaaaaaagcaggctgattaccggagaattcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagcggccgcaaaaagcactctgatttgacaattaaagcactctgatttgacaattaaagcactctgatttgacaattaaagcactctgatttgacaattaaagcttcgaattctgcatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 114 - DNA, 10876 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacccctctccgcttctgaattctaggcgtgtacggtgggaggcctatataagcagagctcgtttagtgaaccgtcagatcgcctcgagtacccctctccgcttcttacccctctccgcttcttacccctctccgcttctggatccaattcgacccaagtttgtacaaaaaagcaggctgattaccggagaattcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagacaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagcggccgcaaacgatatgggctgaatacaataccaaacgatatgggctgaatacaataccaaacgatatgggctgaatacaataccaaacgatatgggctgaatacaatacaagcttgaggtgatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 115 - DNA, 10684 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatgtcgtcttctgcacttatgaattctaggcgtgtacggtgggaggcctatataagcagagctcgtttagtgaaccgtcagatcgcctcgagtgtcgtcttctgcacttattgtcgtcttctgcacttattgtcgtcttctgcacttatggatccaattcgacccaagtttgtacaaaaaagcaggctgattaccggagaattcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagtcgacggtaccccgcttgaagtctttaattaaaccgcttgaagtctttaattaaaccgcttgaagtctttaattaaacccgggccgcttgaagtctttaattaaagtctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 116 - DNA, 11101 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtctaatacccaatctctcgtcttatccagatgttttatacgccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatgtcgtcttctgcacttatgaattctaggcgtgtacggtgggaggcctatataagcagagctcgtttagtgaaccgtcagatcgcctcgagtgtcgtcttctgcacttattgtcgtcttctgcacttattgtcgtcttctgcacttatggatccaattcgacccaagtttgtacaaaaaagcaggctgattaccggagaattcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagcggccgcaaaaagcactctgatttgacaattaaagcactctgatttgacaattaaagcactctgatttgacaattaaagcactctgatttgacaattaaagcttcgaattctgcatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgaattcccttatgtgagtgtaaaaggcaggcgagtttgtcccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 117 - DNA, 10978 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatgtcgtcttctgcacttatgaattctaggcgtgtacggtgggaggcctatataagcagagctcgtttagtgaaccgtcagatcgcctcgagtgtcgtcttctgcacttattgtcgtcttctgcacttattgtcgtcttctgcacttatggatccaattcgacccaagtttgtacaaaaaagcaggctgattaccggagaattcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttactagttaagtcgacggtaccccgcttgaagtctttaattaaaccgcttgaagtctttaattaaaccgcttgaagtctttaattaaacccgggccgcttgaagtctttaattaaagtctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 118 - DNA, 10795 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatgtcgtcttctgcacttatgaattctaggcgtgtacggtgggaggcctatataagcagagctcgtttagtgaaccgtcagatcgcctcgagtgtcgtcttctgcacttattgtcgtcttctgcacttattgtcgtcttctgcacttatggatccaattcgacccaagtttgtacaaaaaagcaggctgattaccggagaattcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagcggccgcaaaaagcactctgatttgacaattaaagcactctgatttgacaattaaagcactctgatttgacaattaaagcactctgatttgacaattaaagcttcgaattctgcatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 119 - DNA, 10970 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacccctctccgcttctgaattctaggcgtgtacggtgggaggcctatataagcagagctcgtttagtgaaccgtcagatcgcctcgagtacccctctccgcttcttacccctctccgcttcttacccctctccgcttctggatccaattcgacccaagtttgtacaaaaaagcaggctgattaccggagaattcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttactagttaagtcgacggtaccccgcttgaagtctttaattaaaccgcttgaagtctttaattaaaccgcttgaagtctttaattaaacccgggccgcttgaagtctttaattaaagtctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 120 - DNA, 6896 bp, Artificial Sequence
  plasmid construct
tgctggccttttgctcacatgttctttcctgcgttatcccctgattctgtggataaccgtattaccgccttacgcgtgtaaaacgacggccagtagatctgtaatacgactcactatagggcgctagctgctcgccgcagccgaacgaccgagcgcagcgagtcagtgagcgaggaagcggccgcataacttcgtatagcatacattatacgaagttatcagtcgacgggcaggaagaggctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaggatccgcgatatgggctgaatacaaattcagactttgtattcagcccatatcgtttttgaattctctagaccattcgtttggcgcgcgggcccagtaggtaagtgaacatggtcatagctgtttcctaggagatcctggtcatgactagtgcttggattctcaccaataaaaaacgcccggcggcaaccgagcgttctgaacaaatccagatggagttctgaggtcattactggatctatcaacaggagtccaagcgagctctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgctaccggactcagatccaccggtatggctgaaggatccgtcgccaggcagcctgacctcttgacctgcgacgatgagccgatccatatccccggtgccatccaaccgcatggactgctgctcgccctcgccgccgacatgacgatcgttgccggcagcgacaaccttcccgaactcaccggactggcgatcggcgccctgatcggccgctctgcggccgatgtcttcgactcggagacgcacaaccgtctgacgatcgccttggccgagcccggggcggccgtcggagcaccgatcactgtcggcttcacgatgcgaaaggacgcaggcttcatcggctcctggcatcgccatgatcagctcatcttcctcgagctcgagcctccccagcgggacgtcgccgagccgcaggcgttcttccgccgcaccaacagcgccatccgccgcctgcaggccgccgaaaccttggaaagcgcctgcgccgccgcggcgcaagaggtgcggaagattaccggcttcgatcgggtgatgatctatcgcttcgcctccgacttcagcggcgaagtgatcgcagaggatcggtgcgccgaggtcgagtcaaaactaggcctgcactatcctgcctcaaccgtgccggcgcaggcccgtcggctctataccatcaacccggtacggatcattcccgatatcaattatcggccggtgccggtcaccccagacctcaatccggtcaccgggcggccgattgatcttagcttcgccatcctgcgcagcgtctcgcccgtccatctggaattcatgcgcaacataggcatgcacggcacgatgtcgatctcgattttgcgcggcgagcgactgtggggattgatcgtttgccatcaccgaacgccgtactacgtcgatctcgatggccgccaagcctgcgagctagtcgcccaggttctggcctggcagatcggcgtgatggaagagtgacaattgttgttgttaacttgtttattgcagcttataatggttacaaataaagcaatagcatcacaaatttcacaaataaagcatttttttcactgcattctagttgtggtttgtccaaactcatcaatgtatcttgagctcgatatcaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaagatccataacttcgtatagcatacattatacgaagttatgcggccgcgacgtccacatatacctgccgttcactattatttagtgaaatgagatattatgatattttctgaattgtgattaaaaaggcaactttatgcccatgcaacagaaactataaaaaatacagagaatgaaaagaaacagatagattttttagttctttaggcccgtagtctgcaaatccttttatgattttctatcaaacaaaagaggaaaatagaccagttgcaatccaaacgagagtctaatagaatgaggtcgaaaagtaaatcgcgcgggtttgttactgataaagcaggcaagacctaaaatgtgtaaagggcaaagtgtatactttggcgtcaccccttacatattttaggtctttttttattgtgcgtaactaacttgccatcttcaaacaggagggctggaagaagcagaccgctaacacagtacataaaaaaggagacatgaacgatgaacatcaaaaagtttgcaaaacaagcaacagtattaacctttactaccgcactgctggcaggaggcgcaactcaagcgtttgcgaaagaaacgaaccaaaagccatataaggaaacatacggcatttcccatattacacgccatgatatgctgcaaatccctgaacagcaaaaaaatgaaaaatatcaagttcctgagttcgattcgtccacaattaaaaatatctcttctgcaaaaggcctggacgtttgggacagctggccattacaaaacgctgacggcactgtcgcaaactatcacggctaccacatcgtctttgcattagccggagatcctaaaaatgcggatgacacatcgatttacatgttctatcaaaaagtcggcgaaacttctattgacagctggaaaaacgctggccgcgtctttaaagacagcgacaaattcgatgcaaatgattctatcctaaaagaccaaacacaagaatggtcaggttcagccacatttacatctgacggaaaaatccgtttattctacactgatttctccggtaaacattacggcaaacaaacactgacaactgcacaagttaacgtatcagcatcagacagctctttgaacatcaacggtgtagaggattataaatcaatctttgacggtgacggaaaaacgtatcaaaatgtacagcagttcatcgatgaaggcaactacagctcaggcgacaaccatacgctgagagatcctcactacgtagaagataaaggccacaaatacttagtatttgaagcaaacactggaactgaagatggctaccaaggcgaagaatctttatttaacaaagcatactatggcaaaagcacatcattcttccgtcaagaaagtcaaaaacttctgcaaagcgataaaaaacgcacggctgagttagcaaacggcgctctcggtatgattgagctaaacgatgattacacactgaaaaaagtgatgaaaccgctgattgcatctaacacagtaacagatgaaattgaacgcgcgaacgtctttaaaatgaacggcaaatggtacctgttcactgactcccgcggatcaaaaatgacgattgacggcattacgtctaacgatatttacatgcttggttatgtttctaattctttaactggcccatacaagccgctgaacaaaactggccttgtgttaaaaatggatcttgatcctaacgatgtaacctttacttactcacacttcgctgtacctcaagcgaaaggaaacaatgtcgtgattacaagctatatgacaaacagaggattctacgcagacaaacaatcaacgtttgcgcctagcttcctgctgaacatcaaaggcaagaaaacatctgttgtcaaagacagcatccttgaacaaggacaattaacagttaacaaataaaaacgcaaaagaaaatgccgatatcctattggcattgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttt

SEQ ID NO: 121 - DNA, 6896 bp, Artificial Sequence
  plasmid construct
tgctggccttttgctcacatgttctttcctgcgttatcccctgattctgtggataaccgtattaccgccttacgcgtgtaaaacgacggccagtagatctgtaatacgactcactatagggcgctagctgctcgccgcagccgaacgaccgagcgcagcgagtcagtgagcgaggaagcggccgcataacttcgtatagcatacattatacgaagttatcagtcgacgggcaggaagaggctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaggatccggcttgaagtctttaattaaattcagactttaattaaagacttcaagcggtttgaattctctagaccattcgtttggcgcgcgggcccagtaggtaagtgaacatggtcatagctgtttcctaggagatcctggtcatgactagtgcttggattctcaccaataaaaaacgcccggcggcaaccgagcgttctgaacaaatccagatggagttctgaggtcattactggatctatcaacaggagtccaagcgagctctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgctaccggactcagatccaccggtatggctgaaggatccgtcgccaggcagcctgacctcttgacctgcgacgatgagccgatccatatccccggtgccatccaaccgcatggactgctgctcgccctcgccgccgacatgacgatcgttgccggcagcgacaaccttcccgaactcaccggactggcgatcggcgccctgatcggccgctctgcggccgatgtcttcgactcggagacgcacaaccgtctgacgatcgccttggccgagcccggggcggccgtcggagcaccgatcactgtcggcttcacgatgcgaaaggacgcaggcttcatcggctcctggcatcgccatgatcagctcatcttcctcgagctcgagcctccccagcgggacgtcgccgagccgcaggcgttcttccgccgcaccaacagcgccatccgccgcctgcaggccgccgaaaccttggaaagcgcctgcgccgccgcggcgcaagaggtgcggaagattaccggcttcgatcgggtgatgatctatcgcttcgcctccgacttcagcggcgaagtgatcgcagaggatcggtgcgccgaggtcgagtcaaaactaggcctgcactatcctgcctcaaccgtgccggcgcaggcccgtcggctctataccatcaacccggtacggatcattcccgatatcaattatcggccggtgccggtcaccccagacctcaatccggtcaccgggcggccgattgatcttagcttcgccatcctgcgcagcgtctcgcccgtccatctggaattcatgcgcaacataggcatgcacggcacgatgtcgatctcgattttgcgcggcgagcgactgtggggattgatcgtttgccatcaccgaacgccgtactacgtcgatctcgatggccgccaagcctgcgagctagtcgcccaggttctggcctggcagatcggcgtgatggaagagtgacaattgttgttgttaacttgtttattgcagcttataatggttacaaataaagcaatagcatcacaaatttcacaaataaagcatttttttcactgcattctagttgtggtttgtccaaactcatcaatgtatcttgagctcgatatcaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaagatccataacttcgtatagcatacattatacgaagttatgcggccgcgacgtccacatatacctgccgttcactattatttagtgaaatgagatattatgatattttctgaattgtgattaaaaaggcaactttatgcccatgcaacagaaactataaaaaatacagagaatgaaaagaaacagatagattttttagttctttaggcccgtagtctgcaaatccttttatgattttctatcaaacaaaagaggaaaatagaccagttgcaatccaaacgagagtctaatagaatgaggtcgaaaagtaaatcgcgcgggtttgttactgataaagcaggcaagacctaaaatgtgtaaagggcaaagtgtatactttggcgtcaccccttacatattttaggtctttttttattgtgcgtaactaacttgccatcttcaaacaggagggctggaagaagcagaccgctaacacagtacataaaaaaggagacatgaacgatgaacatcaaaaagtttgcaaaacaagcaacagtattaacctttactaccgcactgctggcaggaggcgcaactcaagcgtttgcgaaagaaacgaaccaaaagccatataaggaaacatacggcatttcccatattacacgccatgatatgctgcaaatccctgaacagcaaaaaaatgaaaaatatcaagttcctgagttcgattcgtccacaattaaaaatatctcttctgcaaaaggcctggacgtttgggacagctggccattacaaaacgctgacggcactgtcgcaaactatcacggctaccacatcgtctttgcattagccggagatcctaaaaatgcggatgacacatcgatttacatgttctatcaaaaagtcggcgaaacttctattgacagctggaaaaacgctggccgcgtctttaaagacagcgacaaattcgatgcaaatgattctatcctaaaagaccaaacacaagaatggtcaggttcagccacatttacatctgacggaaaaatccgtttattctacactgatttctccggtaaacattacggcaaacaaacactgacaactgcacaagttaacgtatcagcatcagacagctctttgaacatcaacggtgtagaggattataaatcaatctttgacggtgacggaaaaacgtatcaaaatgtacagcagttcatcgatgaaggcaactacagctcaggcgacaaccatacgctgagagatcctcactacgtagaagataaaggccacaaatacttagtatttgaagcaaacactggaactgaagatggctaccaaggcgaagaatctttatttaacaaagcatactatggcaaaagcacatcattcttccgtcaagaaagtcaaaaacttctgcaaagcgataaaaaacgcacggctgagttagcaaacggcgctctcggtatgattgagctaaacgatgattacacactgaaaaaagtgatgaaaccgctgattgcatctaacacagtaacagatgaaattgaacgcgcgaacgtctttaaaatgaacggcaaatggtacctgttcactgactcccgcggatcaaaaatgacgattgacggcattacgtctaacgatatttacatgcttggttatgtttctaattctttaactggcccatacaagccgctgaacaaaactggccttgtgttaaaaatggatcttgatcctaacgatgtaacctttacttactcacacttcgctgtacctcaagcgaaaggaaacaatgtcgtgattacaagctatatgacaaacagaggattctacgcagacaaacaatcaacgtttgcgcctagcttcctgctgaacatcaaaggcaagaaaacatctgttgtcaaagacagcatccttgaacaaggacaattaacagttaacaaataaaaacgcaaaagaaaatgccgatatcctattggcattgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttt

SEQ ID NO: 122 - DNA, 6896 bp, Artificial Sequence
  plasmid construct
tgctggccttttgctcacatgttctttcctgcgttatcccctgattctgtggataaccgtattaccgccttacgcgtgtaaaacgacggccagtagatctgtaatacgactcactatagggcgctagctgctcgccgcagccgaacgaccgagcgcagcgagtcagtgagcgaggaagcggccgcataacttcgtatagcatacattatacgaagttatcagtcgacgggcaggaagaggctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaggatccggcactctgatttgacaattattcagactaattgtcaaatcagagtgctttttgaattctctagaccattcgtttggcgcgcgggcccagtaggtaagtgaacatggtcatagctgtttcctaggagatcctggtcatgactagtgcttggattctcaccaataaaaaacgcccggcggcaaccgagcgttctgaacaaatccagatggagttctgaggtcattactggatctatcaacaggagtccaagcgagctctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgctaccggactcagatccaccggtatggctgaaggatccgtcgccaggcagcctgacctcttgacctgcgacgatgagccgatccatatccccggtgccatccaaccgcatggactgctgctcgccctcgccgccgacatgacgatcgttgccggcagcgacaaccttcccgaactcaccggactggcgatcggcgccctgatcggccgctctgcggccgatgtcttcgactcggagacgcacaaccgtctgacgatcgccttggccgagcccggggcggccgtcggagcaccgatcactgtcggcttcacgatgcgaaaggacgcaggcttcatcggctcctggcatcgccatgatcagctcatcttcctcgagctcgagcctccccagcgggacgtcgccgagccgcaggcgttcttccgccgcaccaacagcgccatccgccgcctgcaggccgccgaaaccttggaaagcgcctgcgccgccgcggcgcaagaggtgcggaagattaccggcttcgatcgggtgatgatctatcgcttcgcctccgacttcagcggcgaagtgatcgcagaggatcggtgcgccgaggtcgagtcaaaactaggcctgcactatcctgcctcaaccgtgccggcgcaggcccgtcggctctataccatcaacccggtacggatcattcccgatatcaattatcggccggtgccggtcaccccagacctcaatccggtcaccgggcggccgattgatcttagcttcgccatcctgcgcagcgtctcgcccgtccatctggaattcatgcgcaacataggcatgcacggcacgatgtcgatctcgattttgcgcggcgagcgactgtggggattgatcgtttgccatcaccgaacgccgtactacgtcgatctcgatggccgccaagcctgcgagctagtcgcccaggttctggcctggcagatcggcgtgatggaagagtgacaattgttgttgttaacttgtttattgcagcttataatggttacaaataaagcaatagcatcacaaatttcacaaataaagcatttttttcactgcattctagttgtggtttgtccaaactcatcaatgtatcttgagctcgatatcaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaagatccataacttcgtatagcatacattatacgaagttatgcggccgcgacgtccacatatacctgccgttcactattatttagtgaaatgagatattatgatattttctgaattgtgattaaaaaggcaactttatgcccatgcaacagaaactataaaaaatacagagaatgaaaagaaacagatagattttttagttctttaggcccgtagtctgcaaatccttttatgattttctatcaaacaaaagaggaaaatagaccagttgcaatccaaacgagagtctaatagaatgaggtcgaaaagtaaatcgcgcgggtttgttactgataaagcaggcaagacctaaaatgtgtaaagggcaaagtgtatactttggcgtcaccccttacatattttaggtctttttttattgtgcgtaactaacttgccatcttcaaacaggagggctggaagaagcagaccgctaacacagtacataaaaaaggagacatgaacgatgaacatcaaaaagtttgcaaaacaagcaacagtattaacctttactaccgcactgctggcaggaggcgcaactcaagcgtttgcgaaagaaacgaaccaaaagccatataaggaaacatacggcatttcccatattacacgccatgatatgctgcaaatccctgaacagcaaaaaaatgaaaaatatcaagttcctgagttcgattcgtccacaattaaaaatatctcttctgcaaaaggcctggacgtttgggacagctggccattacaaaacgctgacggcactgtcgcaaactatcacggctaccacatcgtctttgcattagccggagatcctaaaaatgcggatgacacatcgatttacatgttctatcaaaaagtcggcgaaacttctattgacagctggaaaaacgctggccgcgtctttaaagacagcgacaaattcgatgcaaatgattctatcctaaaagaccaaacacaagaatggtcaggttcagccacatttacatctgacggaaaaatccgtttattctacactgatttctccggtaaacattacggcaaacaaacactgacaactgcacaagttaacgtatcagcatcagacagctctttgaacatcaacggtgtagaggattataaatcaatctttgacggtgacggaaaaacgtatcaaaatgtacagcagttcatcgatgaaggcaactacagctcaggcgacaaccatacgctgagagatcctcactacgtagaagataaaggccacaaatacttagtatttgaagcaaacactggaactgaagatggctaccaaggcgaagaatctttatttaacaaagcatactatggcaaaagcacatcattcttccgtcaagaaagtcaaaaacttctgcaaagcgataaaaaacgcacggctgagttagcaaacggcgctctcggtatgattgagctaaacgatgattacacactgaaaaaagtgatgaaaccgctgattgcatctaacacagtaacagatgaaattgaacgcgcgaacgtctttaaaatgaacggcaaatggtacctgttcactgactcccgcggatcaaaaatgacgattgacggcattacgtctaacgatatttacatgcttggttatgtttctaattctttaactggcccatacaagccgctgaacaaaactggccttgtgttaaaaatggatcttgatcctaacgatgtaacctttacttactcacacttcgctgtacctcaagcgaaaggaaacaatgtcgtgattacaagctatatgacaaacagaggattctacgcagacaaacaatcaacgtttgcgcctagcttcctgctgaacatcaaaggcaagaaaacatctgttgtcaaagacagcatccttgaacaaggacaattaacagttaacaaataaaaacgcaaaagaaaatgccgatatcctattggcattgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttt

SEQ ID NO: 123 - DNA, 6896 bp, Artificial Sequence
  plasmid construct
tgctggccttttgctcacatgttctttcctgcgttatcccctgattctgtggataaccgtattaccgccttacgcgtgtaaaacgacggccagtagatctgtaatacgactcactatagggcgctagctgctcgccgcagccgaacgaccgagcgcagcgagtcagtgagcgaggaagcggccgcataacttcgtatagcatacattatacgaagttatcagtcgacgggcaggaagaggctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaggatccgccaaagagattcctcataaattcagactttatgaggaatctctttggtttttgaattctctagaccattcgtttggcgcgcgggcccagtaggtaagtgaacatggtcatagctgtttcctaggagatcctggtcatgactagtgcttggattctcaccaataaaaaacgcccggcggcaaccgagcgttctgaacaaatccagatggagttctgaggtcattactggatctatcaacaggagtccaagcgagctctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgctaccggactcagatccaccggtatggctgaaggatccgtcgccaggcagcctgacctcttgacctgcgacgatgagccgatccatatccccggtgccatccaaccgcatggactgctgctcgccctcgccgccgacatgacgatcgttgccggcagcgacaaccttcccgaactcaccggactggcgatcggcgccctgatcggccgctctgcggccgatgtcttcgactcggagacgcacaaccgtctgacgatcgccttggccgagcccggggcggccgtcggagcaccgatcactgtcggcttcacgatgcgaaaggacgcaggcttcatcggctcctggcatcgccatgatcagctcatcttcctcgagctcgagcctccccagcgggacgtcgccgagccgcaggcgttcttccgccgcaccaacagcgccatccgccgcctgcaggccgccgaaaccttggaaagcgcctgcgccgccgcggcgcaagaggtgcggaagattaccggcttcgatcgggtgatgatctatcgcttcgcctccgacttcagcggcgaagtgatcgcagaggatcggtgcgccgaggtcgagtcaaaactaggcctgcactatcctgcctcaaccgtgccggcgcaggcccgtcggctctataccatcaacccggtacggatcattcccgatatcaattatcggccggtgccggtcaccccagacctcaatccggtcaccgggcggccgattgatcttagcttcgccatcctgcgcagcgtctcgcccgtccatctggaattcatgcgcaacataggcatgcacggcacgatgtcgatctcgattttgcgcggcgagcgactgtggggattgatcgtttgccatcaccgaacgccgtactacgtcgatctcgatggccgccaagcctgcgagctagtcgcccaggttctggcctggcagatcggcgtgatggaagagtgacaattgttgttgttaacttgtttattgcagcttataatggttacaaataaagcaatagcatcacaaatttcacaaataaagcatttttttcactgcattctagttgtggtttgtccaaactcatcaatgtatcttgagctcgatatcaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaagatccataacttcgtatagcatacattatacgaagttatgcggccgcgacgtccacatatacctgccgttcactattatttagtgaaatgagatattatgatattttctgaattgtgattaaaaaggcaactttatgcccatgcaacagaaactataaaaaatacagagaatgaaaagaaacagatagattttttagttctttaggcccgtagtctgcaaatccttttatgattttctatcaaacaaaagaggaaaatagaccagttgcaatccaaacgagagtctaatagaatgaggtcgaaaagtaaatcgcgcgggtttgttactgataaagcaggcaagacctaaaatgtgtaaagggcaaagtgtatactttggcgtcaccccttacatattttaggtctttttttattgtgcgtaactaacttgccatcttcaaacaggagggctggaagaagcagaccgctaacacagtacataaaaaaggagacatgaacgatgaacatcaaaaagtttgcaaaacaagcaacagtattaacctttactaccgcactgctggcaggaggcgcaactcaagcgtttgcgaaagaaacgaaccaaaagccatataaggaaacatacggcatttcccatattacacgccatgatatgctgcaaatccctgaacagcaaaaaaatgaaaaatatcaagttcctgagttcgattcgtccacaattaaaaatatctcttctgcaaaaggcctggacgtttgggacagctggccattacaaaacgctgacggcactgtcgcaaactatcacggctaccacatcgtctttgcattagccggagatcctaaaaatgcggatgacacatcgatttacatgttctatcaaaaagtcggcgaaacttctattgacagctggaaaaacgctggccgcgtctttaaagacagcgacaaattcgatgcaaatgattctatcctaaaagaccaaacacaagaatggtcaggttcagccacatttacatctgacggaaaaatccgtttattctacactgatttctccggtaaacattacggcaaacaaacactgacaactgcacaagttaacgtatcagcatcagacagctctttgaacatcaacggtgtagaggattataaatcaatctttgacggtgacggaaaaacgtatcaaaatgtacagcagttcatcgatgaaggcaactacagctcaggcgacaaccatacgctgagagatcctcactacgtagaagataaaggccacaaatacttagtatttgaagcaaacactggaactgaagatggctaccaaggcgaagaatctttatttaacaaagcatactatggcaaaagcacatcattcttccgtcaagaaagtcaaaaacttctgcaaagcgataaaaaacgcacggctgagttagcaaacggcgctctcggtatgattgagctaaacgatgattacacactgaaaaaagtgatgaaaccgctgattgcatctaacacagtaacagatgaaattgaacgcgcgaacgtctttaaaatgaacggcaaatggtacctgttcactgactcccgcggatcaaaaatgacgattgacggcattacgtctaacgatatttacatgcttggttatgtttctaattctttaactggcccatacaagccgctgaacaaaactggccttgtgttaaaaatggatcttgatcctaacgatgtaacctttacttactcacacttcgctgtacctcaagcgaaaggaaacaatgtcgtgattacaagctatatgacaaacagaggattctacgcagacaaacaatcaacgtttgcgcctagcttcctgctgaacatcaaaggcaagaaaacatctgttgtcaaagacagcatccttgaacaaggacaattaacagttaacaaataaaaacgcaaaagaaaatgccgatatcctattggcattgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttt

SEQ ID NO: 124 - DNA, 5426 bp, Artificial Sequence
  plasmid construct
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccggcgcgccttaattaaagatatcgcggccgccgcggatccgtcgacctgcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 125 - DNA, 11296 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagcgcgttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatcggcactgcgtgcgccaattctgcagacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggttaattaacaactttgtatagaaaagttggctccgaattgaatatttgcatgtcgctatgtgttctgggaaatcaccataaacgtgaaatccctatcagtgatagagacttataagttccctatcagtgatagagacaccagagacctggtctcgttttttgtcgagcttccttcgggaagctctccatattttttggatccactagttctagttggctccggtgcccgtcagtgggcagagcgcacatcgcccacagtccccgagaagttgtggggaggggtcggcacttgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtggatcccaagggcgaattcgacccaagtttgtacaaaaaagcaggctggatccccgggtaccggtcgccaccatgtctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgggctttgctcgacgccttagccattgagatgttagataggcaccatactcacttttgccctttagaaggggaaagctggcaagattttttacgtaataacgctaaaagttttagatgtgctttactaagtcatcgcgatggagcaaaagtacatttaggtacacggcctacagaaaaacagtatgaaactctcgaaaatcaattagcctttttatgccaacaaggtttttcactagagaatgcattatatgcactcagcgctgtggggcattttactttaggttgcgtattggaagatcaagagcatcaagtcgctaaagaagaaagggaaacacctactactgatagtatgccgccattattacgacaagctatcgaattatttgatcaccaaggtgcagagccagccttcttattcggccttgaattgatcatatgcggattagaaaaacaacttaaatgtgaaagtgggtccgcgtacagcggatcccgggaattccaattgactagagagggccgcggcagcctgctgacctgcggcgacgtggaggaaaaccccggcccccccgggactagtatgagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcaccaattggagggccgcggcagcctgctgacctgcggcgacgtggaggaaaaccccggccccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaaataccacccagctttcttgtacaaagtggtgaattccggcaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgtcgacctcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaaggggggactggaagggctaattcactcccaacgaagacaagatatccttgatctgtggatctaccacacacaaggctacttccctgattggcagaactacacaccagggccagggatcagatatccactgacctttggatggtgctacaagctagtaccagttgagcaagagaaggtagaagaagccaatgaaggagagaacacccgcttgttacaccctgtgagcctgcatgggatggatgacccggagagagaagtattagagtggaggtttgacagccgcctagcatttcatcacatggcccgagagctgcatccggactgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 126 - DNA, 11589 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagcgcgttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatcggcactgcgtgcgccaattctgcagacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggttaattaacaactttgtatagaaaagttggctccgaattgaatatttgcatgtcgctatgtgttctgggaaatcaccataaacgtgaaatccctatcagtgatagagacttataagttccctatcagtgatagagacaccggcttgaagtctttaattaaattcagactttaattaaagacttcaagcggttttttgtcgagcttccttcgggaagctctccatattttttggatccactagttctagttggctccggtgcccgtcagtgggcagagcgcacatcgcccacagtccccgagaagttgtggggaggggtcggcacttgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtggatcccaagggcgaattcgacccaagtttgtacaaaaaagcaggctggatccccgggtaccggtcgccaccatgtctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgggctttgctcgacgccttagccattgagatgttagataggcaccatactcacttttgccctttagaaggggaaagctggcaagattttttacgtaataacgctaaaagttttagatgtgctttactaagtcatcgcgatggagcaaaagtacatttaggtacacggcctacagaaaaacagtatgaaactctcgaaaatcaattagcctttttatgccaacaaggtttttcactagagaatgcattatatgcactcagcgctgtggggcattttactttaggttgcgtattggaagatcaagagcatcaagtcgctaaagaagaaagggaaacacctactactgatagtatgccgccattattacgacaagctatcgaattatttgatcaccaaggtgcagagccagccttcttattcggccttgaattgatcatatgcggattagaaaaacaacttaaatgtgaaagtgggtccgcgtacagcggatcccgggaattccaattgactagagagggccgcggcagcctgctgacctgcggcgacgtggaggaaaaccccggcccccccgggactagtatggctgaaggatccgtcgccaggcagcctgacctcttgacctgcgacgatgagccgatccatatccccggtgccatccaaccgcatggactgctgctcgccctcgccgccgacatgacgatcgttgccggcagcgacaaccttcccgaactcaccggactggcgatcggcgccctgatcggccgctctgcggccgatgtcttcgactcggagacgcacaaccgtctgacgatcgccttggccgagcccggggcggccgtcggagcaccgatcactgtcggcttcacgatgcgaaaggacgcaggcttcatcggctcctggcatcgccatgatcagctcatcttcctcgagctcgagcctccccagcgggacgtcgccgagccgcaggcgttcttccgccgcaccaacagcgccatccgccgcctgcaggccgccgaaaccttggaaagcgcctgcgccgccgcggcgcaagaggtgcggaagattaccggcttcgatcgggtgatgatctatcgcttcgcctccgacttcagcggcgaagtgatcgcagaggatcggtgcgccgaggtcgagtcaaaactaggcctgcactatcctgcctcaaccgtgccggcgcaggcccgtcggctctataccatcaacccggtacggatcattcccgatatcaattatcggccggtgccggtcaccccagacctcaatccggtcaccgggcggccgattgatcttagcttcgccatcctgcgcagcgtctcgcccgtccatctggaattcatgcgcaacataggcatgcacggcacgatgtcgatctcgattttgcgcggcgagcgactgtggggattgatcgtttgccatcaccgaacgccgtactacgtcgatctcgatggccgccaagcctgcgagctagtcgcccaggttctggcctggcagatcggcgtgatggaagagcaattggagggccgcggcagcctgctgacctgcggcgacgtggaggaaaaccccggccccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaaataccacccagctttcttgtacaaagtggtgaattccggcaattcgatatcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgtcgacctcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaaggggggactggaagggctaattcactcccaacgaagacaagatatccttgatctgtggatctaccacacacaaggctacttccctgattggcagaactacacaccagggccagggatcagatatccactgacctttggatggtgctacaagctagtaccagttgagcaagagaaggtagaagaagccaatgaaggagagaacacccgcttgttacaccctgtgagcctgcatgggatggatgacccggagagagaagtattagagtggaggtttgacagccgcctagcatttcatcacatggcccgagagctgcatccggactgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 127 - DNA, 8761 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgagttaattaatagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttgttgtgctgtctcatcattttggcaaagaattcgacccaagtttgtacaaaaaagcaggctgattaccggagaattccaattggccaccatggcccccccgaccgatgtcagcctgggggacgagctccacttagacggcgaggacgtggcgatggcgcatgccgacgcgctagacgatttcgatctggacatgttgggggacggggattccccgggtccgggatttaccccccacgactccgccccctacggcgctctggatatggccgacttcgagtttgagcagatgtttaccgatgcccttggaattgacgagtacggtgggacgcgtatgaagctactgtcttctatcgaacaagcatgcgatatttgccgacttaaaaagctcaagtgctccaaagaaaaaccgaagtgcgccaagtgtctgaagaacaactgggagtgtcgctactctcccaaaaccaaaaggtctccgctgactagggcacatctgacagaagtggaatcaaggctagaaagactggaacagctatttctactgatttttcctcgagaagaccttgacatgattttgaaaatggattctttacaggatataaaagcattgttaacaggattatttgtacaagataatgtgaataaagatgccgtcacagatagattggcttcagtggagactgatatgcctctaacattgagacagcatagaataagtgcgacatcatcatcggaagagagtagtaacaaaggtcaaagacagttgactgtataaaagcttggtggcggctcaactagttaagggcccggcgcgcctaaggtacccccgggtaactgaaaatccaccggatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 128 - DNA, 11086 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgaattcccttatgtgagtgtaaaaggcaggcgagtttgtcccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatacccctctccgcttctgaattctaggcgtgtacggtgggaggcctatataagcagagctcgtttagtgaaccgtcagatcgcctcgagtacccctctccgcttcttacccctctccgcttcttacccctctccgcttctggatccaattcgacccaagtttgtacaaaaaagcaggctgattaccggagaattcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccaagctgagcaaagaccccaacgagaagcgcgatcacatggtcctgctggagttcgtgaccgccgccgggatcactctcggcatggacgagctgtacaagcaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacattggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaataatcaacatcagtctgataagctagctcaacatcagtctgataagctaatctagttaataatcaacatcagtctgataagctagctcaacatcagtctgataagctaatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggttgcttgcaaaagcagtaattggaaagcactctcaaagaatccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 129 - DNA, 10665 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtgcgtttttatgcttgtagtattgtataatgtttttaagatccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatatagaaccgatcctcccattgaattctaggcgtgtacggtgggaggcctatataagcagagctcgtttagtgaaccgtcagatcgcctcgagtatagaaccgatcctcccatttatagaaccgatcctcccatttatagaaccgatcctcccattggatccaattcgacccaagtttgtacaaaaaagcaggctgattaccggagaattcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagacaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcaactagttaagtcgacggtaccaagcactctgatttgacaattaaagcactctgatttgacaattaaagcactctgatttgacaattaaagcactctgatttgacaattaatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtctaatacccaatctctcgtcttatccagatgttttatacgccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 130 - DNA, 10650 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtttaccgagctcttattggttttcaaacttcattgactgtgccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatatagaaccgatcctcccattgaattctaggcgtgtacggtgggaggcctatataagcagagctcgtttagtgaaccgtcagatcgcctcgagtatagaaccgatcctcccatttatagaaccgatcctcccatttatagaaccgatcctcccattggatccaattcgacccaagtttgtacaaaaaagcaggctgattaccggagaattcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagacaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcataactatctgcactagatgcaccttactatctgcactagatgcaccttactatctgcactagatgcaccttactatctgcactagatgcaccttatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgcgtttttatgcttgtagtattgtataatgtttttaagatccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 131 - DNA, 10644 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtttaccgagctcttattggttttcaaacttcattgactgtgccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatatagaaccgatcctcccattgaattctaggcgtgtacggtgggaggcctatataagcagagctcgtttagtgaaccgtcagatcgcctcgagtatagaaccgatcctcccatttatagaaccgatcctcccatttatagaaccgatcctcccattggatccaattcgacccaagtttgtacaaaaaagcaggctgattaccggagaattcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagacaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttactagttaatgtgcaaatctatgcaaaactgatgtgcaaatccatgcaaaactgatgtgcaaatctatgcaaaactgatgtgcaaatccatgcaaaactgatctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgcgtttttatgcttgtagtattgtataatgtttttaagatccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 132 - DNA, 10650 bp, Artificial Sequence
  plasmid construct
ggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtacctgctttctctgaccagcattctctcccctgggcctgtgccgctttctgtctgcagcttgtggcctgggtcacctctacggctggcccagatccttccctgccgcctccttcaggttccgtcttcctccactccctcttccccttgctctctgctgtgttgctgcccaaggatgctctttccggagcacttccttctcggcgctgcaccacgtgatgtcctctgagcggatcctccccgtgtctgggtcctctccgggcatctctcctccctcacccaaccccatgccgtcttcactcgctgggttcccttttccttctccttctggggcctgtgccatctctcgtttcttaggatggccttctccgacggatgtctcccttgcgtcccgcctccccttcttgtaggcctgcatcatcaccgtttttctggacaaccccaaagtaccccgtctccctggctttagccacctctccatcctcttgctttctttgcctggacaccccgttctcctgtggattcgggtcacctctcactcctttcatttgggcagctcccctaccccccttacctctctagtctgtgctagctcttccagccccctgtcatggcatcttccaggggtccgagagctcagctagtcttcttcctccaacccgggcccctatgtccacttcaggacagcatgtttgctgcctccagggatcctgtgtccccgagctgggaccaccttatattcccagggccggttaatgtggctctggttctgggtacttttatctgtcccctccaccccacagtggggcaagcttattaccctgttatccctaaccggtttaccgagctcttattggttttcaaacttcattgactgtgccaagcttctgacctcttctcttcctcccacagggcctcgagacaattgcatcgatggtaccagtgaaagtctgcaatgaattcgagttggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggagggggctgtccccgtgagctcccaggcgcgcctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcccaggcgcgccaactcggtaccgtatcgatgtcgacgttaacgctagtgatatcaactttgtatagaaaagttggctccgaatttctcgacagatctcatgtgattacgccaagctacgggcggagtactgtcctccgagcggagtactgtcctccgagcggagtactgtcctccgagcggagtactgtcctccgagcggagttctgtcctccgagcggagactctagatatagaaccgatcctcccattgaattctaggcgtgtacggtgggaggcctatataagcagagctcgtttagtgaaccgtcagatcgcctcgagtatagaaccgatcctcccatttatagaaccgatcctcccatttatagaaccgatcctcccattggatccaattcgacccaagtttgtacaaaaaagcaggctgattaccggagaattcgccaccatggtgagcgagctgattaaggagaacatgcacatgaagctgtacatggagggcaccgtgaacaaccaccacttcaagtgcacatccgagggcgaaggcaagccctacgagggcacccagaccatgagaatcaaggcggtcgagggcggccctctccccttcgccttcgacatcctggctaccagcttcatgtacggcagcaaaaccttcatcaaccacacccagggcatccccgacttctttaagcagtccttccccgagggcttcacatgggagagagtcaccacatacgaagacgggggcgtgctgaccgctacccaggacaccagcctccaggacggctgcctcatctacaacgtcaagatcagaggggtgaacttcccatccaacggccctgtgatgcagaagaaaacactcggctgggaggcctccaccgagaccctgtaccccgctgacggcggcctggaaggcagagccgacatggccctgaagctcgtgggcgggggccacctgatctgcaacttgaagaccacatacagatccaagaaacccgctaagaacctcaagatgcccggcgtctactatgtggacagaagactggaaagaatcaaggaggccgacaaagagacctacgtcgagcagcacgaggtggctgtggccagatactgcgacctccctagcaaactggggcacagacaattggagggccgcggcagcctgctgacctgcggcgacgtggaggaaaaccccggccccaccggtttgtcgaccattcgtccgcgcaggccaagtcctgcccgcgagcttctgcccggaccccaaccggatagggttcagccgactgcagatcgtggggtgtctgcgcctgctggcagccctctggatggcttgcccgctcggcggacggtgtcccggacccggctgccatctccccctgcgccctcacctgcgttctcggcgggcagcttcagcgatctgctccgtccgttcgatccgtcgcttcttgatacatcgcttcttgattcgatgcctgccgtcggcacgccgcatacagcggctgccccagcagagtgggatgaggcgcaatcggctctgcgtgcagccgatgacccgccacccaccgtgcgtgtcgctgtcactgccgcgcggccgccgcgcgccaagccggccccgcgacggcgtgctgcgcaaccctccgacgcttcgccggccgcgcaggtggatctacgcacgctcggctacagtcagcagcagcaagagaagatcaaaccgaaggtgcgttcgacagtggcgcagcaccacgaggcactggtgggccatgggtttacacacgcgcacatcgttgcgctcagccaacacccggcagcgttagggaccgtcgctgtcacgtatcagcacataatcacggcgttgccagaggcgacacacgaagacatcgttggcgtcggcaaacagtggtccggcgcacgcgccctggaggccttgctcacggatgcgggggagttgagaggtccgccgttacagttggacacaggccaacttgtgaagattgcaaaacgtggcggcgtgaccgcaatggaggcagtgcatgcatcgcgcaatgcactgacgggtgcccccctgaacctgaccccggaccaagtggtggctatcgccagcaacattggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacaatggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgaccccggaccaagtggtggctatcgccagcaacggtggcggcaagcaagcgctcgaaacggtgcagcggctgttgccggtgctgtgccaggaccatggcctgactccggaccaagtggtggctatcgccagccacgatggcggcaagcaagcgctcgaaacggtgcagcggctgttgccggtgctgtgccaggaccatggcctgaccccggaccaagtggtggctatcgccagcaacggtggcggcaagcaagcgctcgaaagcattgtggcccagctgagccggcctgatccggcgttggccgcgttgaccaacgaccacctcgtcgccttggcctgcctcggcggacgtcctgccatggatgcagtgaaaaagggattgccgcacgcgccggaattgatcagaagagtcaatcgccgtattggcgaacgcacgtcccatcgcgttgccgactacgcgcaagtggttcgcgtgctggagtttttccagtgccactcccacccagcgtacgcatttgatgaggccatgacgcagttcgggatgagcaggaacgggttggtacagctctttcgcagagtgggcgtcaccgaactcgaagcccgcggtggaacgctccccccagcctcgcagcgttgggaccgtatcctccaggcatcagggatgaaaagggccaaaccgtcccctacttcagctcaaacaccggatcaggcgtctttgcatgcattcgccgattcgctggagcgtgaccttgatgcgcccagcccaatgcacgagggagatcagacgcgggcaagcagccgtaaacggtcccgatcggatcgtgctgtcaccggcccctccgcacagcaggctgtcgaggtgcgcgttcccgaacagcgcgatgcgctgcatttgcccctcagctggagggtaaaacgcccgcgtaccaggatctggggcggcctcccggatcccagccccaagaagaagagaaaggtggaggccagcggtggcggctcaaagcttggtggcggctcataacagctgcttttgggattccgttgcagctgcttttgggattccgttgcagctgcttttgggattccgttgcagctgcttttgggattccgttgtctagataactgatctacccagctttcttgtacaaagtggtacgcgtgaattcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatcgacagtactaagcttggtgcgtttttatgcttgtagtattgtataatgtttttaagatccttaattaatagggataacagggtaatctcgaggtttaaacgtcgacgcggccgctactagggacaggattggtgacagaaaagccccatccttaggcctcctccttcctagtctcctgatattgggtctaacccccacctcctgttaggcagattccttatctggtgacacacccccatttcctggagccatctctctccttgccagaacctctaaggtttgcttacgatggagccagagaggatcctgggagggagagcttggcagggggtgggagggaagggggggatgcgtgacctgcccggttctcagtggccaccctgcgctaccctctcccagaacctgagctgctctgacgcggctgtctggtgcgtttcactgatcctggtgctgcagcttccttacacttcccaagaggagaagcagtttggaaaaacaaaatcagaataagttggtcctgagttctaactttggctcttcacctttctagtccccaatttatattgttcctccgtgcgtcagttttacctgtgagataaggccagtagccagccccgtcctggcagggctgtggtgaggaggggggtgtccgtgtggaaaactccctttgtgagaatggtgcgtcctaggtgttcaccaggtcgtggccgcctctactccctttctctttctccatccttctttccttaaagagtccccagtgctatctgggacatattcctccgcccagagcagggtcccgcttccctaaggccctgctctgggcttctgggtttgagtccttggcaagcccaggagaggcgctcaggcttccctgtcccccttcctcgtccaccatctcatgcccctggctctcctgccccttccctacaggggttcctggctctgctctccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatc

SEQ ID NO: 133 - protein, 34 aa, Artificial Sequence
  TALER Protein Module
LTPEQVVAIASHDGGKQAIETVQRLLPVLCQAHG

SEQ ID NO: 134 - protein, 15 aa, Artificial Sequence
  C-terminal sequence
LTPEQVVAIASNGGG

SEQ ID NO: 135 - DNA, 17 bp, Artificial Sequence
  TALER14 binding site
tacccctctccgcttct

SEQ ID NO: 136 - DNA, 20 bp, Artificial Sequence
  TALER10 binding site
tacctcatcaggaacatgtt

SEQ ID NO: 137 - DNA, 18 bp, Artificial Sequence
  TALER12 binding site
tatttcgacgctcattct

SEQ ID NO: 138 - DNA, 17 bp, Artificial Sequence
  TALER 13 binding site
tcccggaagccgatgct

SEQ ID NO: 139 - DNA, 19 bp, Artificial Sequence
  TALER21 binding site
tgtcgtcttctgcacttat

SEQ ID NO: 140 - DNA, 25 bp, Artificial Sequence
  TALER16 binding site
tgccctcggccatcagaaggatctt

SEQ ID NO: 141 - DNA, 21 bp, Artificial Sequence
  TALER9 binding site
tatagaaccgatcctcccatt

SEQ ID NO: 142 - DNA, 14 bp, Artificial Sequence
  TALER1 binding site
tacgactcactata

SEQ ID NO: 143 - DNA, 14 bp, Artificial Sequence
  TALER29 binding site
tccgcctccctctc

SEQ ID NO: 144 - DNA, 14 bp, Artificial Sequence
  TALER35 binding site
tttattccctgaca

SEQ ID NO: 145 - DNA, 25 bp, Artificial Sequence
  TALER17 binding site
tattattggccttaaccatactctt

SEQ ID NO: 146 - DNA, 14 bp, Artificial Sequence
  TALER32 binding site
tacaacacactata

SEQ ID NO: 147 - DNA, 18 bp, Artificial Sequence
  TALER26 binding site
tggtagaccttagggcta

SEQ ID NO: 148 - DNA, 19 bp, Artificial Sequence
  TALER19 binding site
tccatctcctcaaggatgt

SEQ ID NO: 149 - DNA, 13 bp, Artificial Sequence
  TALER31 binding site
taggagtgagtat

SEQ ID NO: 150 - DNA, 14 bp, Artificial Sequence
  TALER30 binding site
tatgatttattata

SEQ ID NO: 151 - DNA, 14 bp, Artificial Sequence
  TALER4 binding site
taccactcactata

SEQ ID NO: 152 - DNA, 25 bp, Artificial Sequence
  TALER18 binding site
tccatgtaaaacatttttctgacat

SEQ ID NO: 153 - DNA, 18 bp, Artificial Sequence
  TALER5 binding site
tactgaataatcaacact

SEQ ID NO: 154 - DNA, 25 bp, Artificial Sequence
  TALER15 binding site
tcctgaccattcatcagccgtctat

SEQ ID NO: 155 - DNA, 14 bp, Artificial Sequence
  TALER2 binding site
taagaataaatata

SEQ ID NO: 156 - DNA, 25 bp, Artificial Sequence
  TALER20 binding site
tctagactcttcacaatgttcttat

SEQ ID NO: 157 - DNA, 19 bp, Artificial Sequence
  TALER24 binding site
tagacaaaccacaactctt

SEQ ID NO: 158 - DNA, 20 bp, Artificial Sequence
  TALER11 binding site
tctttgaaagccccgccact

SEQ ID NO: 159 - DNA, 19 bp, Artificial Sequence
  TALER22 binding site
tagtcagcaccaggcattt

SEQ ID NO: 160 - DNA, 19 bp, Artificial Sequence
  TALER23 binding site
tccggatgctcctcttaat

What is claimed is:

1. A method for achieving the regulated expression of two proteins, comprising the following steps: locating genes encoding said two proteins, named as protein A and protein B, respectively, in expression cassettes; wherein the protein A-encoding gene is located in an expression cassette A-I, and the protein B-encoding gene is located in an expression cassette B-I; wherein said expression cassette A-I comprises the following elements successively from upstream to downstream: a feedback element coding sequence, a promoter A comprising SEQ ID NO: 1 at nucleotides 1-589, a protein A-encoding gene and TALER protein A-encoding gene linked by means of self-cleaving polypeptide encoding gene, a target sequence A-I; wherein said target sequence A-I comprises more than one shRNA1 target sequence; wherein said expression cassette B-I comprises the following elements successively from upstream to downstream: a feedback element coding sequence, a promoter B comprising SEQ ID NO: 3 at nucleotides 1713-2301, a protein B-encoding gene and TALER protein B-encoding gene linked by means of self-cleaving polypeptide encoding gene, a target sequence B-I; wherein said target sequence B-I comprises more than one shRNA2 target sequence; wherein, in said expression cassette A-I, both the upstream and downstream of said promoter A have at least one said TALER protein B target, respectively, or the upstream of said promoter A has no said TALER protein B target but the downstream thereof has at least one said TALER protein B target; wherein in said expression cassette B-I, both the upstream and downstream of said promoter B have at least one said TALER protein A target, respectively, or the upstream of said promoter B has no said TALER protein A target but the downstream of said promoter B has at least one said TALER protein A target; wherein said expression cassette C comprises a constitutive promoter and an activating element-coding sequence successively from upstream to downstream; and wherein a DNA positioned downstream of said feedback element coding sequence is expressed under the stimulation of said activating element; and introducing into host cells a recombinant vector A-I with said expression cassette A-I, a recombinant vector B-I with said expression cassette B-I, and a recombinant vector C with said expression cassette C, wherein expression of said protein A and expression of said protein B are regulated by adding shRNA1 or shRNA2.

2. The method of claim 1, wherein: in said expression cassette A-I, the upstream of said promoter A has one said TALER protein B target and the downstream of said promoter A has one to three said TALER protein B targets; in said expression cassette B-I, the upstream of said promoter B has one said TALER protein A target and the downstream of said promoter B has one to three said TALER protein A targets.

3. The method of claim 2, wherein: in said expression cassette A-I, the distance between the TALER protein B target upstream of said promoter A and the nearest TALER protein B target downstream of said promoter A is 72-100 bp; in said expression cassette B-I, the distance between the TALER protein A target upstream of said promoter B and the nearest TALER protein A target downstream of said promoter B is 72-100 bp.

4. A method for achieving the regulated expression of two proteins, comprising the following steps: locating genes encoding said two proteins, named as protein A and protein B, respectively, in expression cassettes; wherein the protein A-encoding gene is located in an expression cassette A-I, and the protein B-encoding gene is located in an expression cassette B-I; wherein said expression cassette A-I comprises the following elements successively from upstream to downstream: a feedback element coding sequence, a promoter A comprising SEQ ID NO: 6 at nucleotides 1792-2380, a protein A-encoding gene and TALER protein A-encoding gene linked by means of a self-cleaving polypeptide encoding gene, a target sequence A-I; wherein said target sequence A-I comprises a shRNA1-1 target sequence, a shRNA1-n target sequence, wherein n is a natural number of 2 or more; wherein said expression cassette B-I comprises the following elements successively from upstream to downstream: a feedback element coding sequence, a promoter B comprising SEQ ID NO: 7 at nucleotides 1766-2354, a protein B-encoding gene and TALER protein B-encoding gene linked by means of a self-cleaving polypeptide encoding gene, a target sequence B-I; wherein said target sequence B-I comprises a shRNA2-1 target sequence, a shRNA2-n target sequence, wherein n is a natural number of 2 or more; wherein in said expression cassette A-I, both the upstream and downstream of said promoter A have at least one said TALER protein B target, respectively, or the upstream of said promoter A has no said TALER protein B target but the downstream thereof has at least one said TALER protein B target; wherein in said expression cassette B-I, both the upstream and downstream of said promoter B have at least one said TALER protein A target, respectively, or the upstream of said promoter B has no said TALER protein A target but the downstream of said promoter B has at least one said TALER protein A target; wherein said expression cassette C comprises a constitutive promoter- and an activating element-coding sequence successively from upstream to downstream; and wherein a DNA positioned downstream of said feedback element coding sequence is expressed under the stimulation of said activating element; and introducing into host cells a recombinant vector A-I with said expression cassette A-I, a recombinant vector B-I with said expression cassette B-I, and a recombinant vector C with said expression cassette C to regulate expression of said protein A and expression of said protein B by adding shRNA1-1, shRNA1-n, shRNA2-1, or shRNA2-n.

5. The method of claim 4, wherein: in said expression cassette A-I, the upstream of said promoter A has one said TALER protein B target and the downstream of said promoter A has one to three said TALER protein B targets; in said expression cassette B-I, the upstream of said promoter B has one said TALER protein A target and the downstream of said promoter B has one to three said TALER protein A targets.

6. The method of claim 5, wherein: in said expression cassette A-I, the distance between the TALER protein B target upstream of said promoter A and the nearest TALER protein B target downstream of said promoter A is 72-100 bp; in said expression cassette B-I, the distance between the TALER protein A target upstream of said promoter B and the nearest TALER protein A target downstream of said promoter B is 72-100 bp.

7. A method for achieving the regulated expression of two proteins, comprising the following steps: locating genes encoding said two proteins, named as protein A and protein B, respectively, in expression cassettes; wherein the protein A-encoding gene is located in an expression cassette A-I, the protein B-encoding gene is located in an expression cassette B-I, and the protein B-encoding gene is located in an expression cassette D-I; wherein said expression cassette A-I comprises the following elements successively from upstream to downstream: a feedback element coding sequence, a promoter A comprising SEQ ID NO: 4 at nucleotides 5842-6430, a protein A-encoding gene and TALER protein A-encoding gene linked by means of a self-cleaving polypeptide encoding gene, a target sequence A-I; wherein said target sequence A-I comprises a shRNA1-1 target sequence, a shRNA1-n target sequence, wherein n is a natural number of 2 or more; wherein said expression cassette B-I comprises the following elements successively from upstream to downstream: a feedback element coding sequence, a promoter B comprising SEQ ID NO: 5 at nucleotides 6148-6736, a protein B-encoding gene and TALER protein B-encoding gene linked by means of a self-cleaving polypeptide encoding gene, a target sequence B-I; wherein said target sequence B-I comprises a shRNA2-1 target sequence, a shRNA2-n target sequence, wherein n is a natural number of 2 or more; wherein said expression cassette D-I comprises the following elements successively from upstream to downstream: a feedback element coding sequence, a promoter D, a protein B-encoding gene and TALER protein B-encoding gene linked by means of a self-cleaving polypeptide encoding gene, a target sequence D; wherein said target sequence D-I comprises a shRNA3-1 target sequence, a shRNA3-n target sequence, wherein n is a natural number of 2 or more; wherein, in said expression cassette A-I, both the upstream and downstream of said promoter A have at least one said TALER protein B target, respectively, or the upstream of said promoter A has no said TALER protein B target but the downstream thereof has at least one said TALER protein B target; wherein in said expression cassette B-I, both the upstream and downstream of said promoter B have at least one said TALER protein A target, respectively, or the upstream of said promoter B has no said TALER protein A target but the downstream of said promoter B has at least one said TALER protein A target; wherein in said expression cassette D-I, both the upstream and downstream of said promoter D have at least one said TALER protein A target, respectively, or the upstream of said promoter D has no said TALER protein A target, but the downstream of said promoter D has at least one said TALER protein A target; wherein said expression cassette C comprises a constitutive promoter- and an activating element-coding sequence successively from upstream to downstream; a DNA positioned downstream of said feedback element coding sequence is expressed under the stimulation of said activating element; and introducing into host cells a recombinant vector A-I with said expression cassette A-I, a recombinant vector B-I with said expression cassette B-I, a recombinant vector C with said expression cassette C and a recombinant vector D-I with said expression cassette D-I to regulate expression of said protein A and expression of said protein B by adding shRNA1-1, shRNA1-n, shRNA2-1, shRNA2-n, shRNA3-1, shRNA3-n.

8. The method of claim 7, wherein: in said expression cassette A-I, the upstream of said promoter A has one said TALER protein B target and the downstream of said promoter A has one to three said TALER protein B targets; in said expression cassette B-I, the upstream of said promoter B has one said TALER protein A target and the downstream of said promoter B has one to three said TALER protein A targets; and in said expression cassette D-I, the upstream of said promoter D has one said TALER protein A target and the downstream of said promoter D has one to three said TALER protein A targets.

9. The method of claim 8, wherein: in said expression cassette A-I, the distance between the TALER protein B target upstream of said promoter A and the nearest TALER protein B target downstream of said promoter A is 72-100 bp; in said expression cassette B-I, the distance between the TALER protein A target upstream of said promoter B and the nearest TALER protein A target downstream of said promoter B is 72-100 bp; and in said expression cassette D-I, the distance between the TALER protein A target upstream of said promoter D and the nearest TALER protein A target downstream of said promoter D is 72-100 bp.

10. The method according to claim 1, wherein the TALER protein A-encoding sequence and the TALER protein B-encoding sequence are different sequences selected from the group consisting of:
   TALER1 protein encoding gene at nucleotides 1389-4220 of SEQ ID NO: 1,
   TALER2 protein encoding gene at nucleotides 1389-4220 of SEQ ID NO: 2,
   TALER4 protein encoding gene at nucleotides 3101-5932 of SEQ ID NO: 3,
   TALER9 protein encoding gene at nucleotides 5462-9007 of SEQ ID NO:495,
   TALER10 protein encoding gene at nucleotides 3180-6623 of SEQ ID NO: 6,
   TALER11 protein encoding gene at nucleotides 3154-6597 of SEQ ID NO: 7,
   TALER12 protein encoding gene at nucleotides 3093-6332 of SEQ ID NO: 8,
   TALER13 protein encoding gene at nucleotides 3075-6212 of SEQ ID NO: 9,
   TALER14 protein encoding gene at nucleotides 3152-6289 of SEQ ID NO: 10,
   TALER15 protein encoding gene at nucleotides 1394-4597 of SEQ ID NO: 11,
   TALER16 protein encoding gene at nucleotides 1394-4597 of SEQ ID NO: 12,
   TALER17 protein encoding gene at nucleotides 1394-4597 of SEQ ID NO: 13,
   TALER18 protein encoding gene at nucleotides 1394-4597 of SEQ ID NO: 14,
   TALER19 protein encoding gene at nucleotides 3099-6440 of SEQ ID NO: 15,
   TALER20 protein encoding gene at nucleotides 1394-4597 of SEQ ID NO: 16,
   TALER21 protein encoding gene at nucleotides 3004-6345 of SEQ ID NO: 17,
   TALER22 protein encoding gene at nucleotides 1394-3985 of SEQ ID NO: 18,
   TALER23 protein encoding gene at nucleotides 1394-3985 of SEQ ID NO: 19,
   TALER24 protein encoding gene at nucleotides 1394-3985 of SEQ ID NO: 20,
   TALER26 protein encoding gene at nucleotides 3064-6009 of SEQ ID NO: 21,
   TALER29 protein encoding gene at nucleotides 3023-5560 of SEQ ID NO: 22,
   TALER30 protein encoding gene at nucleotides 3223-5760 of SEQ ID NO: 23,
   TALER31 protein encoding gene at nucleotides 4788-7325 of SEQ ID NO: 24,
   TALER32 protein encoding gene at nucleotides 3076-5613 of SEQ ID NO: 25, and
   TALER35 protein encoding gene at nucleotides 2992-5529 of SEQ ID NO: 26.

\* \* \* \* \*